US009266930B1

(12) United States Patent
Sette et al.

(10) Patent No.: US 9,266,930 B1
(45) Date of Patent: Feb. 23, 2016

(54) **INDUCING CELLULAR IMMUNE RESPONSES TO *PLASMODIUM FALCIPARUM* USING PEPTIDE AND NUCLEIC ACID COMPOSITIONS**

(75) Inventors: Alessandro Sette, La Jolla, CA (US); John Sidney, San Diego, CA (US); Scott Southwood, Santee, CA (US); Brian D. Livingston, San Diego, CA (US); Robert Chestnut, Cardiff-by-the-Sea, CA (US); Denise Marie Baker, San Diego, CA (US); Esteban Celis, Rochester, MN (US); Ralph T. Kubo, Carlsbad, CA (US); Howard M. Grey, La Jolla, CA (US)

(73) Assignee: Epimmune Inc., San Diego, CA (US)

( * ) Notice: Subject to any disclaimer, the term of this patent is extended or adjusted under 35 U.S.C. 154(b) by 1304 days.

(21) Appl. No.: 09/390,061

(22) Filed: Sep. 3, 1999

Related U.S. Application Data

(63) Continuation-in-part of application No. 09/017,743, filed on Feb. 3, 1998, now abandoned, and a continuation-in-part of application No. 08/821,739, filed on Mar. 20, 1997, now abandoned, and a continuation-in-part of application No. 08/452,843, filed on May 30, 1995, now abandoned, and a continuation-in-part of application No. 08/454,033, filed on May 26, 1995, now abandoned, and a continuation-in-part of application No. 08/344,824, filed on Nov. 23, 1994, now abandoned, and a continuation-in-part of application No. 08/753,615, filed on Nov. 23, 1996, now abandoned, which is a continuation-in-part of application No. 08/590,298, filed on Jan. 23, 1996, now abandoned, which is a continuation-in-part of application No. 08/452,843, filed on May 30, 1995, now abandoned, which is a continuation-in-part of application No. 08/344,824, filed on Nov. 23, 1994, now abandoned, which is a continuation-in-part of application No. 08/278,634, filed on Jul. 21, 1994, now abandoned, said application No. 08/821,739 is a continuation-in-part of application No. 08/451,913, filed on May 26, 1995, now abandoned.

(60) Provisional application No. 60/013,833, filed on May 21, 1996.

(51) Int. Cl.
*A61K 39/002* (2006.01)
*A61K 39/015* (2006.01)
*C07K 14/44* (2006.01)
*C07K 14/445* (2006.01)
*A61K 39/00* (2006.01)

(52) U.S. Cl.
CPC ............. *C07K 14/445* (2013.01); *A61K 39/002* (2013.01); *A61K 2039/572* (2013.01); *A61K 2039/605* (2013.01); *C07K 2319/01* (2013.01)

(58) Field of Classification Search
USPC ......... 530/327, 328; 424/272.1, 268.1, 185.1, 424/191.1, 193.1; 514/2, 14, 15, 885
See application file for complete search history.

(56) References Cited

U.S. PATENT DOCUMENTS

| | | |
|---|---|---|
| 4,235,877 A | 11/1980 | Fullerton |
| 4,487,715 A | 12/1984 | Nitecki et al. |
| 4,599,230 A | 7/1986 | Milich et al. |
| 4,837,028 A | 6/1989 | Allen |
| 5,013,548 A | 5/1991 | Haynes et al. |
| 5,028,425 A | 7/1991 | Good et al. |
| 5,128,319 A | 7/1992 | Arlinghaus |
| 5,662,907 A * | 9/1997 | Kubo et al. ................ 424/185.1 |
| 5,736,142 A | 4/1998 | Sette et al. |
| 5,766,899 A | 6/1998 | Kuo et al. |
| 5,783,567 A | 7/1998 | Hedley et al. |
| 5,880,103 A | 3/1999 | Urban et al. |

FOREIGN PATENT DOCUMENTS

| | | |
|---|---|---|
| EP | 0 429 816 | 6/1991 |
| EP | 0 433 242 | 6/1991 |
| EP | 0 378 881 | 6/1993 |
| WO | 90/06130 * | 6/1990 |
| WO | WO 92/01796 A1 | 2/1992 |
| WO | WO 93/03764 | 3/1993 |
| WO | WO 93/20103 | 10/1993 |
| WO | WO 94/06464 A1 | 3/1994 |
| WO | WO 94/20127 | 9/1994 |
| WO | WO 95/07094 A1 | 3/1995 |

(Continued)

OTHER PUBLICATIONS

Richie et al., Nature, 415:694-701, 2002.*
Alexander, J., et al., "Development of High Potency Universal DR-Restricted Helper Epitopes by Modification of High Affinity DR-Blocking Peptides," *Immunity* 1:751-761, Cell Press (1994).
Arndt, S.O., et al., "Selection of the MHC Class II-Associated Peptide Repertoire by HLA-DM," *Immunol. Res.* 16:261-272, Humana Press (Dec. 1997).
Barouch, D., et al., "HLA-A2 Subtypes Are Functionally Distinct in Peptide Binding and Presentation," *J. Exp. Med.* 182:1847-1856, Rockefeller University Press (1995).
Bender, A., et al. "Improved methods for the generation of dendritic cells from nonproliferating progenitors in human blood," *J. Immunol. Methods* 196:121-135, Elsevier Science (1996).

(Continued)

*Primary Examiner* — Ron Schwadron
(74) *Attorney, Agent, or Firm* — Sterne, Kessler, Goldstein & Fox P.L.L.C.

(57) ABSTRACT

This invention uses our knowledge of the mechanisms by which antigen is recognized by T cells to identify and prepare *Plasmodium falciparum* epitopes, and to develop epitope-based vaccines directed towards malaria. More specifically, this application communicates our discovery of pharmaceutical compositions and methods of use in the prevention and treatment of malaria. In particular, this application discloses isolated peptides comprising oligopeptides, for example the oligopeptide GVSENIFLK, or isolated peptides conjugated with T helper peptides that are used as antigens in epitope-based vaccines to prevent and/or treat malaria.

4 Claims, 1 Drawing Sheet

(56) References Cited

FOREIGN PATENT DOCUMENTS

| WO | WO 95/07707 | 3/1995 |
|---|---|---|
| WO | WO 95/26982 | 10/1995 |
| WO | WO 96/22067 | 7/1996 |
| WO | WO 97/34617 | 9/1997 |
| WO | WO 97/41440 | 11/1997 |
| WO | WO 01/00225 | 1/2001 |

OTHER PUBLICATIONS

Ben-Yedidia, T., and Arnon, R., "Design of peptide and polypeptide vaccines," *Curr. Opin. Biotechnol.* 8:442-448, Current Biology, Ltd. (1997).

Carbone, F.R., and Bevan, M.J., "Induction of Ovalbumin-Specific Cytotoxic T Cells by in Vivo Peptide Immunization," *J. Exp. Med.* 169:603-612, Rockefeller University Press (1989).

Carbone, F.R., et al., "Induction of Cytotoxic T Lymphocytes by Primary in Vitro Stimulation with Peptides," *J. Exp. Med.* 167:1767-1779, Rockefeller University Press (1988).

Cassell, D., and Forman, J., "Linked Recognition of Helper and Cytotoxic Antigenic Determinants for the Generation of Cytotoxic T Lymphocytes," *Ann. N.Y. Acad. Sci.* 532:51-60, New York Academy of Sciences (1991).

Deres, K., et al., "In vivo priming of virus-specific cytotoxic T lymphocytes with synthetic lipopeptide vaccine," *Nature* 342:561-564, Nature Publishing Group (1989).

del Guercio, M-F., et al., "Potent immunogenic short linear peptide constructs composed of B cell epitopes and Pan DR T Helper Epitopes (PADRE) for antibody responses in vivo," *Vaccine* 15:441-448, Elsevier Science (Mar. 1997).

DiBrino, M., et al., "Endogenous Peptides with Distinct Amino Acid Anchor Residue Motifs Bind to HLA-A1 and HLA-B8," *J. Immunol.* 152:620-631, American Association of Immunologists (1994).

DiBrino, M., et al., "The HLA-B14 Peptide Binding Site Can Accommodate Peptides with Different Combinations of Anchor Residues," *J. Biol. Chem.* 269:32426-32434, American Society for Biochemistry and Molecular Biology (1994).

Donnelly, J.J., et al., "DNA Vaccines," *Annu. Rev. Immunol.* 15:617-648, Annual Reviews Inc. (Apr. 1997).

Francis, M.J., et al., "Non-responsiveness to a foot-and-mouth disease virus peptide overcome by addition of foreign helper T-cell determinants," *Nature* 330:168-170, Nature Publication Group (1987).

Fynan, E.F., et al., "DNA vaccines: Protective immunizations by parental, mucosal, and gene-gun inoculations," *Proc. Natl. Acad. Sci. USA* 90:11478-11482, National Academy of Sciences (1993).

Gileadi, U., et al., "Effect of epitope flanking residues on the presentation of N-terminal cytotoxic T lymphocyte epitopes," *Eur. J. Immunol.* 29:2213-2222, WILEY-VCH Verlag GmbH (Jul. 1999).

Golvano, J., et al., "Polarity of immunogens: implications for vaccine design," *Eur. J. Immunol.* 20:2363-2366, VCH Verlagsgesellschaft mbH (1990).

Gulukota, K., et al., "Two Complementary Methods for Predicting Peptides Binding Major Histocompatibility Complex Molecules," *J. Mol. Biol.* 267:1258-1267, Academic Press Limited (Apr. 1997).

Hahn, Y.S., et al., "CD8$^+$ T Cell Recognition of an Endogenously Processed Epitope is Regulated Primarily by Residues within the Epitope," *J. Exp. Med.* 176:1335-1341, Rockefeller University Press (1992).

Hahn, Y.S., et al., "Presentation of Viral Antigen to Class I Major Histocompatibility Complex-Restricted Cytotoxic T Lymphocyte. Recognition of an Immunodominant Influenza Hemagglutinin Site by Cytotoxic T Lymphocyte is Independent of the Position of the Site in the Hemagglutinin Translation Product," *J. Exp. Med.* 174:733-736, Rockefeller University Press (1991).

Hammer, J., et al., "Precise Prediction of Major Histocompatibility Complex Class II-Peptide Interaction Based on Peptide Side Chain Scanning," *J. Exp. Med.* 180:2353-2358, Rockefeller University Press (1994).

Hill, C.M., et al., "Exploration of Requirements for Peptide Binding to HLA DRB1*0101 and DRB1*0401," *J. Immunol.* 152:2890-2898, American Association of Immunologists (1994).

Huczko, E.L., et al., "Characteristics of Endogenous Peptides Eluted from the Class I MHC Molecule HLA-B7 Determined by Mass Spectrometry and Computer Modeling," *J. Immunol.* 151:2572-2587, American Association of Immunologists (1993).

Ishioka, G.Y., et al., "Class I MHC-restricted, peptide specific cytotoxic T lymphocytes generated by peptide priming in vivo," in *Vaccines90: Modern Approaches to New Vaccines Including Prevention of AIDS*, Brown, F., et al., eds., Cold Spring harbor Laboratory Press, Cold Spring Harbor, NY, pp. 7-11 (1990).

Ishioka, G.Y., et al., "Induction of Class I MHC-Restricted, Peptide-Specific Cytolytic T Lymphocytes by Peptide Priming in Vivo," *J. Immunol.* 143:1094-1100, American Association of Immunologists (1989).

Jardetzky, T.S., et al., "Peptide binding to HLA-DR1: a peptide with most residues substituted to alanine retains MHC binding," *EMBO J.* 9:1797-1803, Oxford University Press (1990).

Kast, W.M., et al., "Protection against lethal Sendai virus infection by in vivo priming of virus-specific cytotoxic T lymphocytes with a free synthetic peptide," *Proc. Natl. Acad. Sci. USA* 88:2283-2287, National Academy of Sciences (1991).

Kondo, A., et al., "Two distinct *HLA-A*0101*-specific submotifs illustrate alternative peptide binding modes," *Immunogenetics* 45:249-258, Springer-Verlag (Jan. 1997).

Kubitscheck, U., et al., "Peptide Binding to Class I Molecules of the Major Histocompatibility Complex on the Surface of Living Target Cells," *Scand. J. Immunol.* 36:341-348, Blackwell Scientific Publications (1992).

Kubo, R.T., et al., "Definition of Specific Peptide Motifs for Four Major HLA-A Alleles," *J. Immunol.* 152:3913-3924, American Association of Immunologists (1994).

Kumar, A., et al., "Universal T Helper Cell Determinants Enhance Immunogenicity of a *Plasmodium falciparum* Merozoite Surface Antigen Peptide," *J. Immunol.* 148:1499-1505, American Association of Immunologists (1992).

Lasarte, J-J., et al., "Induction of Cytotoxic T Lymphocytes in Mice against the Principal Neutralizing Domain of HIV-1 by Immunization with an Engineered T-Cytotoxic-T-Helper Synthetic Helper Peptide Construct," *Cell. Immunol.* 141:211-218, Academic Press Inc. (1992).

Madden, D.R., et al., "The structure of HLA-B27 reveals nonamer self-peptides bound in an extended conformation," *Nature* 353:321-325, Nature Publishing Group (1991).

Martinon, F., et al., "Immunization of Mice with Lipopeptides Bypasses the Prerequisite for Adjuvant," *J. Immunol.* 149:3416-3422, American Association of Immunologists (1992).

Niedermann, G., et al., "Contribution of Proteasome-Mediated Proteolysis to the Hierarchy of Epitopes Presented by Major Histocompatibility Complex Class I Molecules," *Immunity* 2:289-299, Cell Press (1995).

Niedermann, G., et al., "The specificity of proteasomes: impact on MHC class I processing and presentation of antigens," *Immunol. Rev.* 172:29-48, Munksgaard (Dec. 1999).

Nikolić-Žugić, J., and Carbone, F.R., "Peptide Presentation by Class-I Major Histocompatibility Complex Molecules," *Immunol. Res.* 10:54-65, S. Karger AG (1991).

O'Sullivan, D., et al., "Characterization of the Specificity of Peptide Binding to Four DR Haplotypes," *J. Immunol.* 145:1799-1808, American Association of Immunologists (1990).

O'Sullivan, D., et al., "On the Interaction of Promiscuous Antigenic Peptides with Different DR Alleles," *J. Immunol.* 147:2663-2669, American Association of Immunologists (1991).

Panina-Bordignon, P., et al., "Universally immunogenic T cell eptiopes: promiscuous binding to human MHC class II and promiscuous recognition by T cells," *Eur. J. Immunol.* 19:2237-2242, VCH Verlagsgesellschaft mbH (1989).

Paz, P., et al., "Discrete Proteolytic Intermediates in the MHC Class I Antigen Processing Pathway and MHC I-Dependent Peptide Trimming in the ER," *Immunity* 11:241-251, Cell Press (Aug. 1999).

(56) References Cited

OTHER PUBLICATIONS

Penna, A., et al., "Cytotoxic T Lymphocytes Recognize an HLA-A2-Restricted Epitope Within the Hepatitis B Virus Nucleocapsid Antigen," *J. Exp. Med.* 174:1565-1570, Rockefeller University Press (1991).
Rahemtulla, A., et al., "Normal development and function of CD8+ cells but markedly decreased helper cell activity in mice lacking CD4," *Nature* 353:180-183, Nature Publishing Group (1991).
Rammensee, H-G., et al., "SYFPEITHI: database for MHC ligands and peptide motifs," *Immunogenetics* 50:213-219, Springer-Verlag (Nov. 1999).
Reitermann, A., et al., "Lipopeptide Derivatives of Bacterial Lipoprotein Constitute Potent Immune Adjuvants Combined with or Covalently Coupled to Antigen or Hapten," *Biol. Chem. Hoppe Seyler* 370:343-352, Walter De Gruyter (1989).
Restifo, N.P., et al., "Antigen Processing in Vivo and the Elicitation of Primary CTL Responses," *J. Immunol.* 154:4414-4422, American Association of Immunologists (1995).
Saper, M.A., et al., "Refined Structure of the Human Histocompatibility Antigen HLA-A2 at 2.6 ÅResolution," *J. Mol. Biol.* 219:277-319, Academic Press Ltd. (1991).
Schaeffer, E.B., et al., "Relative contribution of 'determinant selection' and 'holes in the T cell repertoire' to T-cell responses," *Proc. Natl. Acad. Sci. USA* 86:4649-4653, National Academy of Sciences (1989).
Schumacher, T.N.M., et al., "Peptide selection by MHC class I molecules," *Nature* 350:703-706, Nature Publishing Group (1991).
Sette, A., and Sidney, J., "HLA supertypes and supermotifs: a functional perspective on HLA polymorphism," *Curr. Opin. Immunol.* 10:478-482, Current Biology Publications (Aug. 1998).
Sette, A., et al., "A Novel Approach to the Generation of High Affinity Class II-Binding Peptides," *J. Immunol.* 145:1809-1813, American Association of Immunologists (1990).
Sette, A., et al., "Effect of Conformational Propensity of Peptide Antigens in Their Interaction with MHC Class II Molecules," *J. Immunol.* 143:1268-1273, American Association of Immunologists (1989).
Sette, A., et al., "Peptide Binding to the Most Frequent HLA-A Class I Alleles Measured by Quantitative Molecular Binding Assays," *Mol. Immunol.* 31:813-822, Pergamon Press (1994).
Sidney, J., et al., "Definition of an HLA-A3-Like Supermotif Demonstrates the Overlapping Peptide-Binding Repertoires of Common HLA Molecules," *Hum. Immunol.* 45:79-93, Elsevier Science Inc. (1996).
Sidney, J., et al., "Practical, biochemical and evolutionary implications of the discovery of HLA class I supermotifs," *Immunol. Today* 17:261-266, Elsevier Science (1996).
Sidney, J., et al., "The HLA-A*0207 Peptide Binding Repertoire is Limited to a Subset of the A*0201 Repertoire," *Hum. Immunol.* 58:12-20, Elsevier Science Inc. (Nov. 1997).
Sinigaglia, F., and Hammer, J., "Defining rules for the peptide-MHC class II interaction," *Curr. Opin. Immunol.* 6:52-56, Current Biology Ltd. (1994).
Southwood, S., et al., "Several Common HLA-DR Types Share Largely Overlapping Peptide Binding Repertoires," *J. Immunol.* 160:3363-3373, American Association of Immunologists (Apr. 1998).
Sprent, J., and Schaefer, M., "Properties of Purified T Cell Subsets. I. In Vitro Responses to Class I vs. Class II H-2 Alloantigens," *J. Exp. Med.* 162:2068-2088, Rockefeller University Press (1985).
Stark, J.M., et al., "Immunogenicity of lipid-conjugated antigens. I. The Influence of Chain Length and Degree of Conjugation on Induction of Antibody in Mice," *Immunology* 39:345-352, Blackwell Scientific Publications (1980).
Steinman, R.M., "Dendritic cells and immune-based therapies," *Exp. Hematol.* 24:859-862, Elsevier Science Inc. (1996).
Sudo, T., et al., "Differences in MHC Class I Self Peptide Repertoires Among HLA-A2 Subtypes," *J. Immunol.* 155:4749-4756, American Association of Immunologists (1995).

Sugawara, S., et al., "A simple method to eliminate the antigenicity of surface class I MHC molecules from the membrane of viable cells by acid treatment at pH 3," *J. Immunol. Methods* 100:83-90, Elsevier Science (1987).
Tam, J.P., and Lu, Y-A., "Vaccine engineering: Enhancement of immunogenicity of synthetic peptide vaccines related to hepatitis in chemically defined models consisting of T-and B-cell epitopes," *Proc. Natl. Acad. Sci. USA* 86:9084-9088, National Academy of Sciences (1989).
Townsend, A., and Bodmer, H., "Antigen Recognition by Class I-Restricted T Lymphocytes," *Ann. Rev. Immunol.* 7:601-624, Annual Reviews, Inc. (1989).
von Boehmer, H., and Haas, W., "Distinct Ir Genes for Helper and Killer Cells in the Cytotoxic Response to H-Y Antigen," *J. Exp. Med.* 150:1134-1142, Rockefeller University Press (1979).
Watari, E., et al., "A Synthetic Peptide Induces Long-Term Protection from Lethal Infection with Herpes Simplex Virus 2," *J. Exp. Med.* 165:459-470, Rockefeller University Press (1987).
Wentworth, P.A., et al., "In Vitro Induction of Primary, Antigen-Specific CTL from Human Peripheral Blood Mononuclear Cells Stimulated with Synthetic Peptides," *Mol. Immunol.* 32:603-612, Elsevier Science Ltd. (1995).
Wherry, E.J., et al., "The Induction of Virus-Specific CTL as a Function of Increasing Epitope Expression: Responses Rise Steadily Until Excessively High Levels of Epitope Are Attained," *J. Immunol.* 163:3735-3745, American Association of Immunologists (Oct. 1999).
Widmann, C., et al., "T helper epitopes enhance the cytotoxic response of mice immunized with MHC class I-restricted malaria peptides," *J. Immunol. Meth.* 155:95-99, Elsevier Science Publishers B.V. (1992).
Wiesmüller, K-H., et al., "Lipopeptide-Helper-T-Cell Epitope-CTL Epitope Conjugate Induces Antibodies Against the CTL Epitope," *Innovation Perspective Solid Phase Synthesis Collect. Papers, Int. Symp. 2nd*, pp. 499-502 (1991).
Wiesmüller, K-H., et al., "Novel low-molecular-weight synthetic vaccine against foot-and mouth disease containing a potent B cell and macrophage activator," *Vaccine* 7:29-33, Butterworth & Co. (1989).
Yewdell, J.W., and Bennink, J.R., "Immunodominance in Major Histocompatibility Complex Class I-Restricted T Lymphocyte Responses," *Annu. Rev. Immunol.* 17:51-88, Annual Reviews Inc. (Apr. 1999).
Zhou, X., et al., "In vivo primary induction of virus-specific CTL by immunization with 9-mer synthetic peptides," *J. Immunol. Methods* 153:193-200, Elsevier Science Publishers B.V. (1992).
Zinkernagel, R.M., et al., "The Lymphoreticular System in Triggering Virus Plus Self-Specific Cytotoxic T Cells: Evidence for T Help," *J. Exp. Med.* 147:897-911, Rockefeller University Press (1978).
Altuvia, Y. et al., "A Structure-Based Algorithm to Predict Potential Binding Peptides to MHC Molecules with Hydrophobic Binding Pockets," *Human Immunol.* 58:1-11, Elsevier Science Inc. (1997).
Aggarwal, A., et al., "Oral *Salmonella*: Malaria Circumsporozoite Recombinants Induce Specific CD8+ Cytotoxic T Cells," *J. Exp. Med.* 172:1083-1090, Rockefeller University Press (1990).
Doolan, D.L., et al., "Degenerate Cytotoxic T Cell Epitopes from P. falciparum Restricted by Multiple HLA-A and HLA-B Supertype Alleles," *Immunity* 7:97-112, Cell Press (1997).
Doolan, D.L., et al., "HLA-DR-Promiscuous T Cell Epitopes from *Plasmodium falciparum* Pre-Erythrocytic-Stage Antigens Restricted by Multiple HLA Class II Alleles," *J. Immunol.* 165:1123-1137, American Association of Immunologists (2000).
González, J.M., et al., "HLA-A*0201 restricted CD8+ T-lymphocyte responses to malaria: identification of new *Plasmodium falciparum* epitopes by IFN-γ ELISPOT," *Parasite Immunol.* 22:501-514, Blackwell Scientific Publications (2000).
Hanke, T., et al., "DNA multi-CTL epitope vaccines for HIV and *Plasmodium falciparum*: immunogenicity in mice," *Vaccine* 16:426-435, Elsevier Science (Feb. 1998).
Hill, A.V.S., et al., "Molecular analysis of the association of HLA-B53 and resistance to severe malaria," *Nature* 360:434-439, Nature Publishing Group (1992).

(56) References Cited

OTHER PUBLICATIONS

Jolivet, M., et al., "Polyvalent synthetic vaccines: relationship between T epitopes and th immunogenicity," *Vaccine* 8:35-40, Butterworth & Co. (1990).

Perkins, D.L., et al., "Immunodominance: Intramolecular Competition Between T Cell Epitopes," *J. Immunol.* 146:2137-2144, American Association of Immunologists (1991).

Rammensee, H-G., et al., "MHC ligands and peptide motifs: first listing," *Immunogen.* 41:178-228, Springer-Verlag (1995).

Romero, P., et al., "Immunization with Synthetic Peptides Containing a Defined Malaria Epitope Induces a Highly Diverse Cytotoxic T Lymphocyte Response. Evidence That Two Peptide Residues are Buried in the MHC Molecule," *J. Immunol.* 148:1871-1878, American Association of Immunologists (1992).

Sidney, J., et al., "DRB1*0301 Molecules Recognize a Structural Motif Distinct from the One Recognized by Most DR $\beta_1$ Alleles," *J. Immunol.* 149:2634-2640, American Association of Immunologists (1992).

van der Most, R.G., et al., "Analysis of Cytotoxic T Cell Responses to Dominant and Subdominant Epitopes During Acute and Chronic Lymphocytic Choriomeningitis Virus Infection," *J. Immunol.* 157:5543-5554, American Association of Immunologists (1996).

Derwent World Patent Index, English Abstract of EP 0 431 327 (Document AL200), Dialog File No. 351, Accession No. 8645471.

Aichele, P., et al., "Antiviral cytotoxic T cell response induced by in vivo priming with a free synthetic peptide," *J. Exp. Med.* 171:1815-1820, Rockefeller University Press (1990).

Alexander, J., et al., "Derivation of HLA-All/Kb Transgenic Mice," *J. Immunol.* 159:4753-4761, The American Association of Immunologists (Nov. 1997).

Bergmann, C.C., et al., "Differential Effects of Flanking Residues on Presentation of Epitopes from Chimeric Peptides," *J. Virol.* 68:5306-5310, American Society for Microbiology (Aug. 1994).

Bertoni, R., et al., "Human Histocompatibility Leukocyte Antigen-binding Supermotifs Predict Broadly Cross-reactive Cytotoxic T Lymphocyte Responses in Patients with Acute Hepatitis," *J. Clin. Invest.* 100:503-513, The American Society for Clinical Investigation, Inc. (Aug. 1997).

Bertoni, R., et al., "Human Class I Supertypes and CTL Repertoires Extend to Chimpanzees" *J. Immunol.* 161:4447-4455, American Association of Immunologists (Oct. 1998).

Bjorkman, P.J., et al., "Structure of the human class I histocompatibility antigen, HLA-A2," *Nature* 329:506-512, Macmillan Publishers, Ltd. (1987).

Bjorkman, P.J., et al., "The foreign antigen binding site and T cell recognition regions of class I histocompatibility antigens," *Nature* 329:512-518, Macmillan Publishers, Ltd. (1987).

Buus, S. et al., "Autologous Peptides Constitutively Occupy the Antigen Binding Site on IA," *Science* 242:1045-1047, American Association for the Advancement of Science (1988).

Carreno, B.M., et al., "HLA-B37 and HLA-A2.1 molecules bind largely nonoverlapping sets of peptides," *Proc. Natl. Acad. Sci. USA* 87:3420-3424, National Academy Press (1990).

Corr, M., et al., "Endogenous Peptides of a Soluble Major Histocompatibility Complex Class I Molecule, H-2L$^d$,: Sequence Motif, Quantitative Binding, and Molecular Modeling of the Complex," *J. Exp. Med.* 176:1681-1692, Rockefeller University Press (Dec. 1992).

De Bruijn, M.L.H., et al., "Peptide loading of empty major histocompatibility complex molecules on RMA-S cells allows the induction of primary cytotoxic T lymphocyte responses," *Eur. J. Immunol.* 21:2963-2970, VCH Verlagsgesellschaft mbH (1991).

Del Val, M., et al., "Efficient Processing of an Antigenic Sequence for Presentation by MHC Class I Molecules Depends on Its Neighboring Residues in the Protein," *Cell* 66:1145-1153, Cell Press (1991).

Deres, K., et al., "In vivo priming of virus-specific cytotoxic T lymphocytes with synthetic lipopeptide vaccine," *Nature* 342:561-564, Macmillan Publishers, Ltd. (1989).

Dibrino, M., et al., "Endogenous peptides bound to HLA-A3 possess a specific combination of anchor residues that permit identification of potential antigenic peptides," *Proc. Natl. Acad. Sci. USA* 90:1508-1512, National Academy Press (Feb. 1993).

Eisenlohr, L.C., et al., "Flanking Sequences Influence the Presentation of an Endogenously Synthesized Peptide to Cytotoxic T Lymphocytes," *J. Exp. Med.* 175:481-487, The Rockefeller University Press (Feb. 1992).

Engelhard, V.H., "Structure of peptides associated with MHC class I molecules," *Curr. Opin. Immunol.* 6:13-23, Current Biology, Ltd. (Feb. 1994).

Falk, K., et al., "Allele-specific motifs revealed by sequencing of self-peptides eluted from MHC molecules," *Nature* 351:290-296, Macmillan Publishers, Ltd. (1991).

Falk, K., et al., "MHC peptide motif register. Peptide motifs of HLA-B35 and -B37 molecules," *Immunogenetics* 38:161-162, Springer-Verlag (Apr. 1993).

Falk, K. et al., "Allele-specific peptide ligand motifs of HLA-C molecules," *Proc. Natl. Acad. Sci. USA* 90:12005-12009, National Academy Press (Dec. 1993).

Falk, K., et al., "Pool sequencing of natural HLA-DR, DQ, and DP ligands reveals detailed peptide motifs, constraints of processing, and general rules," *Immunogenetics* 39:230-242, Springer-Verlag (Feb. 1994).

Falk, K., et al., "Peptide motifs of HLA-A1, -A11, -A31, and -A33 molecules," *Immunogenetics* 40:238-241, Springer-Verlag (Jul. 1994).

Foon, K.A., "Biological Response Modifiers: The New Immunotherapy," *Cancer Res.* 49:1621-1639, American Association for Cancer Research (1989).

Geysen, H.M., et al., "Cognitive Features of Continuous Antigenic Determinants," *J. Mol. Recognit.* 1:32-41, Heyden & Sons, Ltd. (1988).

Guo, H.-C., et al., "Different length peptides bind to HLA-Aw68 similarly at their ends but bulge out in the middle," *Nature* 360:364-366, Macmillan Publishers, Ltd. (Nov. 1992).

Henderson, H.A., et al., "HLA-A2.1-Associated Peptides from a Mutant Cell Line: A Second Pathway of Antigen Presentation," *Science* 255:1264-1266, American Association for the Advancement of Science (Mar. 1992).

Hill, A., et al., "Characterization of two Epstein-Barr virus epitopes restricted by HLA-B7," *Eur. J. Immunol.* 25:18-24, VCH Verlagsgesellschaft mbH (Jan. 1995).

Hunt, D.F., et al., "Characterization of Peptides Bound to the Class I MHC Molecule HLA-A2.1 by Mass Spectrometry," *Science* 255:1261-1263, American Association for the Advancement of Science (Mar. 1992).

Ishioka, G.Y., et al., "Utilization of MHC Class I Transgenic Mice for Development of Minigene DNA Vaccines Encoding Multiple HLA-Restricted CTL Epitopes," *J. Immunol.* 162:3915-3925, The American Association of Immunologists (Apr. 1999).

Jameson, S.C., and Bevan, M.J., "Dissection of major histocompatibility complex (MHC) and T cell receptor contact residues in a K$^b$-restricted ovalbumin peptide and an assessment of the predictive power of MHC-binding motifs," *Eur. J. Immunol.* 22:2663-2667, Vch Verlagsgesellschaft Mbh (Oct. 1992).

Jardetzky, T.S., et al., Identification of self peptides bound to purified HLA-B27, *Nature* 353:326-329, Macmillan Publishers, Ltd. (1991).

Kannagi, M., et al., "Target Epitope in the Tax Protein of Human T-Cell Leukemia Virus Type I Recognized by Class I Major Histocompatibility Complex-Restricted T Cells," *J. Virol.* 66:2928-2933, American Society for Microbiology (May 1992).

Kast, W.M., et al., "Protection against lethal Sendai virus infection by in vivo priming of virus-specific cytotoxic T lymphocytes with a free synthetic peptide," *Proc. Natl. Acad. Sci. USA* 88:2283-2287, National Academy Press (1991).

Kast, W.M., et al., "Strict peptide length is not required for the induction of cytotoxic T lymphocyte-mediated antiviral protection by peptide vaccination," *Eur. J. Immunol.* 23:1189-1192, Vch Verlagsgesellschaft Mbh (May 1993).

Krieger, J.I., et al., "Single amino acid changes in DR and antigen define residues critical for peptide-MHC binding and T cell recognition," *J. Immunol.* 146:2331-2340, American Association of Immunologists (1991).

(56) References Cited

OTHER PUBLICATIONS

Lipford, G.B., et al., "Primary in Vivo Responses to Ovalbumin," *J. Immunol.* 150:1212-1222, The American Association of Immunologists (Feb. 1993).

Maryanski, J.L., et al., "Synthetic peptides as antigens and competitors in recognition by H-2-restricted cytolytic T cells specific for HLA," *J. Exp. Med.* 167:1391-1405, Rockefeller University Press (1988).

Maryanski, J.L., et al., "Competitor Analogs for Defined T Cell Antigens: Peptides Incorporating a Putative Binding Motif and Polyproline or Polyglycine Spacers," *Cell* 60:63-72, Cell Press (1990).

Morrison, J., et al., "Identification of the nonamer peptide from influenza A matrix protein and the role of pockets of HLA-A2 in its recognition by cytotoxic T lymphocytes," *Eur. J. Immunol.* 22:903-907, VCH Verlagsgesellschaft mbH (Apr. 1992).

Niedermann, G., et al., "The proteolytic fragments generated by vertebrate proteosomes: Structural relationships to major histocompatibility complex class I binding peptides," *Proc. Natl. Acad. Sci. USA* 93:8572-8577, National Academy Press (Aug. 1996).

Ochoa-Garay, J., et al., "The ability of peptides to induce cytotoxic T cells in vitro does not strongly correlate with their affinity for the H-2L$^d$ molecule: implications for vaccine design and immunotherapy," *Mol. Immunol.* 34:273-281, Elsevier Science, Ltd. (Feb. 1997).

Pamer, E.G., et al., "Precise prediction of a dominant class I MHC-restricted epitome of *Listeria monocytogenes*," *Nature* 353:852-855,Macmillan Publishers, Ltd. (1991).

Parham, P. et al., "The Origins of HLA-A,B,C Polymorphism," *Immunol. Rev.* 143:141-180, Munksgaard (Feb. 1995).

Parker, K.C., et al., "Peptide Binding to HLA-A2 and HLA-B27 Isolated from *Escherichia coli*," *J. Biol. Chem.* 267:5451-5459, American Society for Biochemistry and Molecular Biology, Inc. (Mar. 1992).

Parker, K.C., et al., "Sequence motifs important for peptide binding to the human MHC class I molecule, HLA-A2," *J. Immunol.* 149:3580-3587, American Association of Immunologists (Dec. 1992).

Patarroyo, M.E., et al., "Induction of protective immunity against experimental infection with malaria using synthetic peptides," *Nature* 328:629-632, Macmillan Publishers, Ltd. (1987).

Rammensee, H.-G., et al., "Peptides Naturally Presented by MHC Class I Molecules," *Annu. Rev. Immunol.* 11:213-244, Annual Reviews, Inc. (Jan. 1993).

Rammensee, H.-G., et al., "MHC ligands and peptide motifs: first listing," *Immunogenetics* 41:178-228, Springer-Verlag (Feb. 1995).

Reddehase, M.J., et al., "A pentapeptide as minimal antigenic determinant for MHC class I-restricted T lymphocytes," *Nature* 337:651-653, Macmillan Publishers, Ltd. (1989).

Robson, K.J.H., et al., "A highly conserved amino-acid sequence in thrombospondin, properdin and in proteins from sporozoites and blood stages of a human malaria parasite," *Nature* 335:79-82, Macmillan Publishers, Ltd. (1988).

Romero, P., et al., "H-2K$^d$-restricted Antigenic Peptides Share a Simple Binding Motif," *J. Exp. Med.* 174:603-612, Rockefeller University Press (1991).

Rothbard, J.B., "Major histocompatibility complex-peptide interactions," *Curr. Opin. Immunol.* 2:99-105, Current Biology, Ltd. (1989).

Rötzschke, O., et al., "Isolation and analysis of naturally processed viral peptides as recognized by cytotoxic T cells," *Nature* 348:252-254, Macmillan Publishers, Ltd. (1990).

Rötzschke, O., et al., "Characterization of Naturally Occurring Minor Histocompatibility Peptides Including H-4 and H-Y," *Science* 249:283-287, American Association for the Advancement of Science (1990).

Rötzschke, O., et al., "Naturally-occurring peptide antigens derived from the MHC class-I-restricted processing pathway," *Immunol. Today* 12:447-455, Elsevier Science Publishers, Ltd. (1991).

Rötzschke, O., et al., "Peptide motifs of closely related HLA class I molecules encompass substantial differences," *Eur. J. Immunol.* 22:2453-2456, VCH Verlagsgesellschaft mbH (Sep. 1992).

Rötzschke, O., and Falk, K., "Origin, structure and motifs of naturally processed MHC class II ligands," *Curr. Opin. Immunol.* 6:45-51, Current Biology, Ltd (Feb. 1994).

Rudinger, J., "Characteristics of the amino acids as components of a peptide hormone sequence," in *Peptide Hormones*, Parsons, J.A., ed., University Park Press, Baltimore, MD, pp. 1-7 (1976).

Ruppert, J., et al., "Prominent Role of Secondary Anchor Residues in Peptide Binding to HLA-A2.1 Molecules," *Cell* 74:929-937, Cell Press (Sep. 1993).

Schulz, M., et al., "Major histocompatibility complex binding and T cell recognition of a viral nonapeptide containing a minimal tetrapeptide," *Eur. J. Immunol.* 21:1181-1185, VCH Verlagsgesellschaft mbH (1991).

Sette, A., et al., "Prediction of major histocompatibility complex binding regions of protein antigens by sequence pattern analysis," *Proc. Natl. Acad. Sci. USA* 86:3296-3300, National Academy Press (1989).

Sette, A., et al., "Random association between the peptide repertoire of A2.1 class I and several different DR class II molecules," *J. Immunol.* 147:3893-3900, American Association of Immunologists (1991).

Sette, A., et al., "The Relationship Between Class I Binding Affinity and Immunogenicity of Potential Cytotoxic T Cell Epitopes," *J. Immunol.* 153:5586-5592, American Association of Immunologists (Dec. 1994).

Shastri, N., et al., Presentation of Endogenous Peptide/MHC Class I Complexes is Profoundly Influenced by Specific C-Terminal Flanking Residues, *J. Immunol.* 155:4339-4346, The American Association of Immunologists (Nov. 1995).

Sherman, L.A., et al., "Extracellular Processing of Peptide Antigens That Bind Class I Major Histocompatibility Molecules," *J. Exp. Med.* 175:1221-1226, The Rockefeller University Press (May 1992).

Shimojo, N., et al., "Specificity of peptide binding by the HLA-A2.1 Molecule," *J. Immunol.* 143:2939-2947, American Association of Immunologists (1989).

Sidney, J., et al., "Several HLA Alleles Share Overlapping Peptide Specificities," *J. Immunol.* 154:247-259, American Association of Immunologists (Jan. 1995).

Threlkeld, S.C., et al., "Degenerate and Promiscuous Recognition by CTL of Peptides Presented by the MHC Class I A3-like Superfamily. Implications for Vaccine Development," *J. Immunol.* 159:1648-1657, The American Association of Immunologists (Aug. 1997).

Wentworth, P.A., et al., "Differences and similarities in the A2.1-restricted cytotoxic T cell repertoire in humans and human leukocyte antigen-transgenic mice," *Eur. J. Immunol.* 26:97-101,Vch Verlagsgesellschaft Mbh (Jan. 1996).

Whitton, J.L., et al., "Molecular Analyses of a Five-Amino-Acid Cytotoxic T-Lymphocyte (CTL) Epitope: an Immunodominant Region Which Induces Nonreciprocal CTL Cross-Reactivity," *J. Virol.* 63:4303-4310, American Society for Microbiology (1989).

Yewdell, J.W., and Bennink, J.R., "Cell biology of antigen and presentation to major histocompatibility complex class I molecule-restricted T lymphocytes," *Adv. Immunol.* 52:1-123, Academic Press (Jul. 1992).

York, I.A., and Rock, K.L., "Antigen processing and presentation by the class I major histocompatibility complex," *Annu. Rev. Immunol.* 14:369-396 Annual Reviews (Apr. 1996).

Zhang, Q-J., et al., "An HLA-A11-specific motif in nonamer peptides derived from viral and cellular proteins," *Proc. Natl. Acad. Sci. USA* 90:2217-2221, National Academy Press (Mar. 1993).

Cerami, C. et al., "The Basolateral Domain of the Hepatocyte Plasma Membrane Bears Receptors for the Circumsporozoite Protein of Plasmodium falciparum Sporozoites," *Cell* 70:1021-1033, Cell Press (Sep. 1992).

Sinnis, P., et al., "Structural and Functional Properties of Region II-Plus of the Malaria Circumsporozoite Protein," *J. Exp. Med.* 180:297-306, The Rockefeller University Press (Jul. 1994).

Blondelle, S.E., and Houghten, R.A., "Comparison of 55% TFA/ CH$_2$Cl$_2$ and 100% TFA for Boc group removal during solid-phase

(56) References Cited

OTHER PUBLICATIONS peptide synthesis," *Int. J. Peptide Protein Res.* 41:522-527, Munksgaard International Publishers Ltd. (Jun. 1993).

Blum-Tirouvanziam, U., et al., "Localization of HLA-A2.1-Restricted T Cell Epitopes in the Circumsporozoite Protein of *Plasmodium falciparum*," *J. Immunol.* 154:3922-3931, The American Association of Immunologists (Apr. 1995).

Dontfraid, F., et al., "Human and Murine CD4 T Cell Epitopes Map to the Same Region of the Malaria Circumsporozoite Protein: Limited Immunogenicity of Sporozoites and Circumsporozoite Protein," *Mol. Biol. Med.* 5:185-196, Academic Press Ltd. (1988).

Doolan, D.L., et al., "Cytotoxic T Lymphocyte (CTL) low-responsiveness to the *Plasmodium falciparum* circumsporozoite protein in naturally-exposed endemic populations: analysis of human CTL response to most known variants," *Int. Immunol.* 5:37-46, Oxford University Press (Jan. 1993).

Good, M.F., et al., "Human T-cell recognition of the circumsporozoite protein of *Plasmodium falciparum*: Immunodominant T-cell domains map to the polymorphic regions of the molecule," *Proc. Natl. Acad. Sci. USA* 85:1199-1203, National Academy of Sciences (1988).

Wizel, B., et al., "HLA-A2-Restricted Cytotoxic T Lymphocyte Responses to Multiple *Plasmodium falciparum* Sporozoite Surface Protein 2 Epitopes in Sporozoite-Immunized Volunteers," *J. Immunol.* 155:766-775, The American Association of Immunologists (Jul. 1995).

Zevering, Y., et al., "High frequency of malaria-specific T cells in non-exposed humans," *Eur. J. Immunol.* 22:689-696, VCH Verlagsgesellschaft mbH (Mar. 1992).

Zhu, J. & Hollingdale, M.R., "Structure of *Plasmodium falciparum* liver stage antigen-1," *Molecular and Biochemical Parasitology*, 48:223-226, Elsevier Science Publishers B.V., United Kingdom (1991).

\* cited by examiner

Monte Carlo Analysis of Pf CTL epitopes

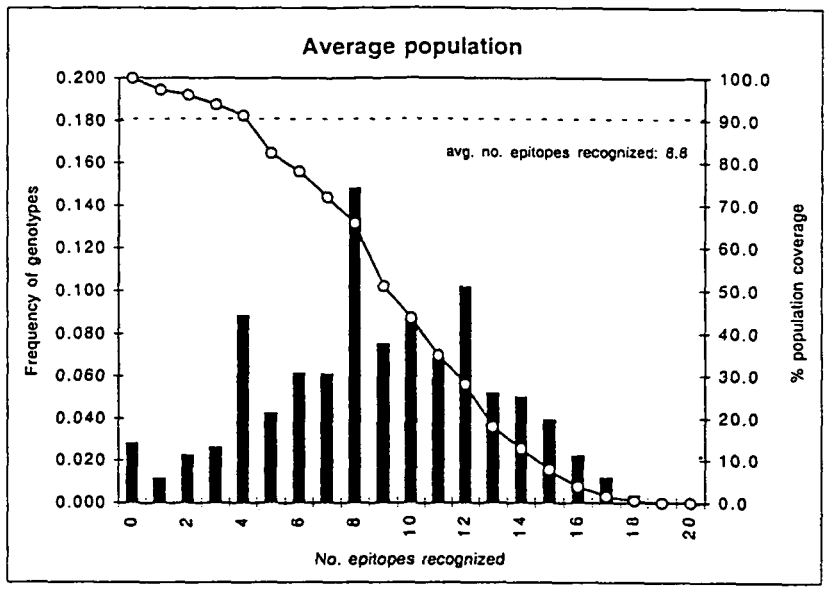

Plot of total frequency of genotypes as a function of the number of candidate epitopes bound by HLA-A and B alleles, in an average population. Genotype values were derived by averaging the gene frequencies in Caucasian, North American Black, Japanese, Chinese, and Hispanic populations. Also shown is the cumulative frequency of genotypes.

Using currently available HLA typing data, a residual fraction (about 15%) of the genes, in an average population, are unspecified. To arrive at 100% accounting of genes, a fraction of the residual has been added for each hit population cluster in proportion to the relative frequency of the cluster within the HLA specified population.

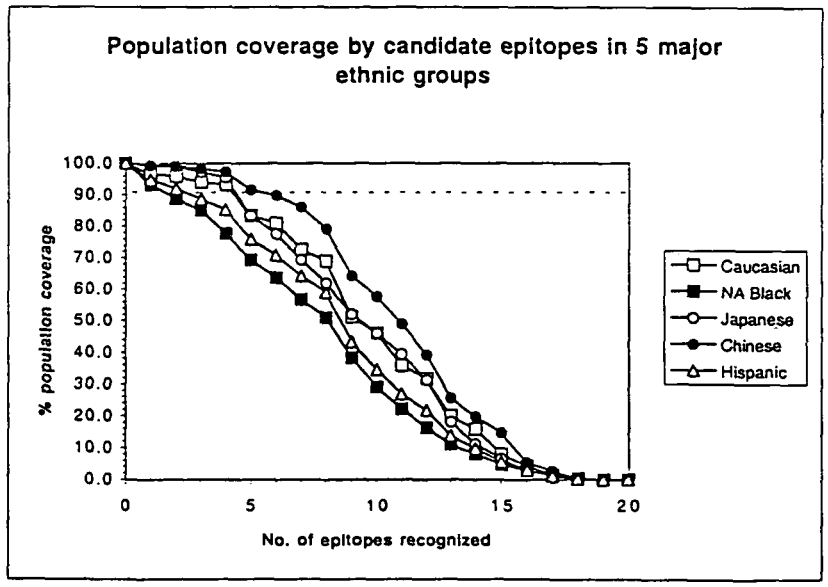

Plot of the cumulative frequency of genotypes as a function of the number of candidate epitopes bound by HLA-A and B alleles, in an average population. Average genotype values were calculated by averaging the gene frequencies, derived as described above, in Caucasian, North American Black, Japanese, Chinese, and Hispanic populations.

INDUCING CELLULAR IMMUNE RESPONSES TO *PLASMODIUM FALCIPARUM* USING PEPTIDE AND NUCLEIC ACID COMPOSITIONS

CROSS-REFERENCES TO RELATED APPLICATIONS

This application is a continuation-in-part of U.S. application Ser. No. 09/017,743, filed Feb. 3, 1998 (abandoned); and is a continuation-in-part of U.S. application Ser. No. 08/821,739, filed Mar. 20, 1997 (abandoned); and is a continuation-in-part of U.S. application Ser. No. 08/452,843, filed May 30, 1995 (abandoned); and is a continuation-in-part of U.S. application Ser. No. 08/454,033, filed May 26, 1995 (abandoned); and is a continuation-in-part of U.S. application Ser. No. 08/344,824, filed Nov. 23, 1994 (abandoned); said Ser. No. 09/017,743 (abandoned) is a continuation-in-part of U.S. application Ser. No. 08/753,615, filed Nov. 23, 1996 (abandoned); which is a continuation-in-part of U.S. application Ser. No. 08/590,298, filed Jan. 23, 1996 (abandoned); which is a continuation-in-part of said Ser. No. 08/452,843, filed May 30, 1995 (abandoned); which is a continuation-in-part of said Ser. No. 08/344,824, filed Nov. 23, 1994 (abandoned); which is a continuation-in-part of U.S. application Ser. No. 08/278,634, filed Jul. 21, 1994 (abandoned); said Ser. No. 08/821,739 (abandoned) claims the benefit of U.S. Provisional Application No. 60/013,833, filed Mar. 21, 1996 (now inactive); and is a continuation-in-part of U.S. application Ser. No. 08/451,913, filed May 26, 1995 (abandoned).

This application is related to U.S. Ser. No. 09/189,702 filed Nov. 10, 1998, now U.S. Pat. No. 7,252,829, which is a CIP of U.S. Ser. No. 08/205,713 filed Mar. 4, 1994 (abandoned), which is a CIP of Ser. No. 08/159,184 filed Nov. 29, 1993 and now abandoned, which is a CIP of Ser. No. 08/073,205 filed Jun. 4, 1993 and now abandoned, which is a CIP of Ser. No. 08/027,146 filed Mar. 5, 1993 and now abandoned. The present application is also related to U.S. Ser. No. 09/226,775 (abandoned), which is a CIP of abandoned U.S. Ser. No. 08/815,396, which claims benefit of abandoned U.S. Ser. No. 60/013,113 filed Mar. 21, 1996. Furthermore, the present application is related to U.S. Ser. No. 09/017,735 (abandoned), which is a CIP of abandoned U.S. Ser. No. 08/589,108; U.S. Ser. No. 08/454,033 (abandoned); and U.S. Ser. No. 08/349,177 (abandoned). The present application is also related to U.S. Ser. No. 09/017,524 (abandoned), U.S. Ser. No. 08/821,739 (abandoned), which claims benefit of abandoned U.S. Ser. No. 60/013,833 filed Mar. 21, 1996; and U.S. Ser. No. 08/347,610 (abandoned), which is a CIP of U.S. Ser. No. 08/159,339, now U.S. Pat. No. 6,037,135, which is a CIP of abandoned U.S. Ser. No. 08/103,396, which is a CIP of abandoned U.S. Ser. No. 08/027,746, which is a CIP of abandoned U.S. Ser. No. 07/926,666. The present application is also related to U.S. Ser. No. 09/017,743 (abandoned), which is a CIP of abandoned U.S. Ser. No. 08/590,298; and U.S. Ser. No. 08/452,843 (abandoned), which is a CIP of U.S. Ser. No. 08/344,824 (abandoned), which is a CIP of abandoned U.S. Ser. No. 08/278,634. The present application is also related to PCT application PCT/US99/12066 filed May 28, 1999 which claims benefit of provisional U.S. Ser. No. 60/087,192, filed May 29, 1998 (now inactive), and U.S. Ser. No. 09/009,953 (abandoned), which is a CIP of abandoned U.S. Ser. No. 60/036,713 and abandoned U.S. Ser. No. 60/037,432. In addition, the present application is related to U.S. Ser. No. 09/098,584 (abandoned), U.S. Ser. No. 09/239,043 now U.S. Pat. No. 6,689,363, and to Provisional U.S. Patent Application 60/117,486 filed Jan. 27, 1999 (now inactive). The present application is also related to Ser. No. 09/350,401 filed Jul. 8, 1999, and U.S. Ser. No. 09/357,737 filed Jul. 19, 1999. All of the above applications are incorporated herein by reference.

FEDERALLY SPONSORED RESEARCH AND DEVELOPMENT

This invention was funded, in part, by the United States government under grants with the National Institutes of Health. The U.S. government has certain rights in this invention.

The Substitute Sequence Listing written in file Substitute Sequence Listing 2060_0040004, 699,629 bytes, created on Mar. 14, 2003, on compact discs for application Ser. No. 09/390,061, Sette et al., Inducing Cellular Immune Responses to *Plasmodium falciparum* Using Peptide and Nucleic Acid Compositions, is herein incorporated-by-reference.

---

INDEX

I. Background of the Invention
II. Summary of the Invention
III. Brief Description of the Figures
IV. Detailed Description of the Invention
   A. Definitions
   B. Stimulation of CTL and HTL responses
   C. Binding Affinity of Peptide Epitopes for HLA Molecules
   D. Peptide Epitope Binding Motifs and Supermotifs
      1. HLA-A1 supermotif
      2. HLA-A2 supermotif
      3. HLA-A3 supermotif
      4. HLA-A24 supermotif
      5. HLA-B7 supermotif
      6. HLA-B27 supermotif
      7. HLA-B44 supermotif
      8. HLA-B58 supermotif
      9. HLA-B62 supermotif
      10. HLA-A1 motif
      11. HLA-A2.1 motif
      12. HLA-A3 motif
      13. HLA-A11 motif
      14. HLA-A24 motif
      15. HLA-DR-1-4-7 supermotif
      16. HLA-DR3 motifs
   E. Enhancing Population Coverage of the Vaccine
   F. Immune Response-Stimulating Peptide Epitope Analogs
   G. Computer Screening of Protein Sequences from Disease-Related Antigens for Supermotif- or Motif-Containing Epitopes
   H. Preparation of Peptide Epitopes
   I. Assays to Detect T-Cell Responses
   J. Use of Peptide Epitopes for Evaluating Immune Responses
   K. Vaccine Compositions
      1. Minigene Vaccines
      2. Combinations of CTL Peptides with Helper Peptides
   L. Administration of Vaccines for Therapeutic or Prophylactic Purposes
   M. Kits
V. Examples
VI. Claims
VII. Abstract

---

I. BACKGROUND OF THE INVENTION

Malaria, which is caused by infection with the parasite *Plasmodium falciparum* (PF), represents a major world health problem. Approximately 500 million people in the world are at risk from the disease, with approximately 200 million people actually harboring the parasites. An estimated 1 to 2 million deaths occur each year due to malaria. (Miller et al., *Science* 234:1349, 1986).

Fatal outcomes are not confined to first infections, and constant exposure is apparently a prerequisite for maintaining immunity. Naturally acquired sterile immunity is rare, if it exists at all. Accordingly, major efforts to develop an efficacious malaria vaccine have been undertaken.

Human volunteers injected with irradiated PF sporozoites are resistant to subsequent sporozoite challenges, which demonstrates that development of a malaria vaccine is indeed immunologically feasible. Furthermore, these immune individuals developed a vigorous response, including antibodies, and cytotoxic T lymphocyte (CTL) and helper T lymphocyte (HTL) components, directed against multiple antigens. Reproducing the breadth and multiplicity of this response in a vaccine, however, is a task of large proportions. The epitope approach, as described herein, may represent a solution to this challenge, in that it allows the incorporation of various antibody, CTL and HTL epitopes, from various proteins, in a single vaccine composition.

Anti-sporozoite antibodies are by themselves, in general, not completely efficacious in clearing the infection (Egan et al., Science 236:453, 1987). However, high concentrations of antibodies directed against the repeated region of the major B cell antigen of the sporozoite/circumsporozoite protein (CSP) have been shown to prevent liver cell infection in certain experimental models (Egan et al., Science 236:453, 1987; Potocnjak, P. et al., Science 207:71, 1980). The present inventors have shown that constructs encompassing CSP-repeat B cell epitopes and the optimized helper epitope PADRE™ (San Diego, Calif.) are highly immunogenic, and can protect in vitro against sporozoite invasion in both mouse and human liver cells, and protect mice in vivo against live sporozoite challenge (Franke et al., Vaccine 17:1201-1205, 1999)

PF-specific $CD4^+$ T cells also have a role in malarial immunity beyond providing help for B cell and CTL responses. Experiments by Renia et al. (Renia, et al., Proc. Natl. Acad. Sci. USA 88:7963, 1991) demonstrated that HTLs directed against the Plasmodium yoelli CS protein could in fact adoptivley transfer protection against malaria.

Considerable data implicate CTLs in protection against pre-erythrocytic-stage malaria. $CD8^+$ CTLs can eliminate Plasmodium berghei- or Plasmodium yoelii-infected mouse hepatocytes from in vitro culture in a major histocompatibility complex (MHC)-restricted and antigen-restricted manner (Hoffman et al., Science 244:1078-1081, 1989; Weiss et al., J. Exp. Med. 171:763-773, 1990). Further, it has also been shown that the immunity that developed in mice vaccinated with irradiated sporozoites is also dependent upon the present of CD8+ T cells. These T cells accumulate in inflammatory liver infiltrates subsequent to challenge. Passive transfer of circumsporozoite (CSP)-specific CTL clones as long as three hours after inoculation of sporozoites (i.e., after the parasites have left the bloodstream and infected liver cells) were capable of protecting animals against infection (Romero et al., Nature 341:323, 1989).

It is notable that CTL-restricted responses directed against a single antigen are insufficient to protect mice with different MHC alleles, and a combination of multiple antigens was required even to protect mice from the most common laboratory strains of Plasmodium. These data indicate that a combination of epitopes form several antigens is necessary to elicit a protective CTL response.

Indirect evidence that CTLs are important in protective immunity against Pf in humans has also accumulated. It has been reported that cytotoxic $CD8^+$ T cells can be identified in humans immunized with PF sporozoites (Moreno, et al., Int. Immunol. 3:997, 1991). Further, humans immunized with irradiated sporozoites or naturally exposed to malaria can generate a CTL response to the pre-erythrocytic-stage antigens, CSP, sporozoite surface protein 2 (SSP2), liver-stage antigen-1 (LSA-1), and exported protein-1 (Exp-1) (see, e.g. Malik et al., Proc. Natl. Acad. Sci. USA 88, 3300-3304, 1991; Doolan et al., Int. Immunol. 3:511-516, 1991; Hill et al., Nature 360:434-439, 1992). Additionally, there is evidence that the polymorphism within the CSP may be the result of selection by CTLs of parasites that express variant forms (MCutchan and Water, Immunol. Lett. 25:23-26, 1990). This is based on the observation that the variation is nonsynonymous at the nucleotide level, thereby indicating selective pressure at the protein level. The polymorphism primarily maps to identified CTL and T helper epitopes (Doolan et al., Int. Immunol. 5:27-46, 1993); and CTL responses to some of the parasite variants do not cross-react (Hill et al., supra). Finally, the MHC class I human leukocyte antigen (HLA)-Bw53 has been associated with resistance to severe malaria in The Gambia, and CTLs to a conserved epitope restricted by the HLA-Bw53 allele have been identified on P. falciparum LSA-1 (Hill et al., Nature 352:595-600, 1991; Hill et al., Nature 340:434-439, 1992). Since HLA-Bw53 is found in 15%-40% of the population of sub-Saharan Africa but in less than 1% of Caucasians and Asians, these data suggest evolutionary selection on the basis of protection against severe malaria.

Thus, antibody, and both HLA class I and class II restricted responses directed against multiple sporozoite antigens appear to be involved in generating protective immunity to malaria. Furthermore, several important antigenic epitopes against which humoral and cellular immunity is focused have already been exactly delineated.

HLA class I molecules are expressed on the surface of almost all nucleated cells. Following intracellular processing of antigens, epitopes from the antigens are presented as a complex with the HLA class I molecules on the surface of such cells. CTL recognize the peptide-HLA class I complex, which then results in the destruction of the cell bearing the HLA-peptide complex directly by the CTL and/or via the activation of non-destructive mechanisms e.g., the production of interferon.

In view of the heterogeneous immune response observed with PF infection, induction of a multi-specific cellular immune response directed simultaneously against multiple PF epitopes appears to be important for the development of an efficacious vaccine against PF. There is a need, however, to establish vaccine embodiments that elicit immune responses that correspond to responses seen in patients that clear PF infection.

The information provided in this section is intended to disclose the presently understood state of the art as of the filing date of the present application. Information is included in this section which was generated subsequent to the priority date of this application. Accordingly, information in this section is not intended, in any way, to delineate the priority date for the invention.

II. SUMMARY OF THE INVENTION

This invention applies our knowledge of the mechanisms by which antigen is recognized by T cells, for example, to develop epitope-based vaccines directed towards PF. More specifically, this application communicates our discovery of specific epitope pharmaceutical compositions and methods of use in the prevention and treatment of PF infection.

Upon development of appropriate technology, the use of epitope-based vaccines has several advantages over current vaccines, particularly when compared to the use of whole antigens in vaccine compositions. There is evidence that the immune response to whole antigens is directed largely toward variable regions of the antigen, allowing for immune escape due to mutations. The epitopes for inclusion in an epitope-based vaccine are selected from conserved regions of antigens of pathogenic organisms or tumor-associated antigens, which thereby reduces the likelihood of escape mutants. Furthermore, immunosuppressive epitopes that may be present in whole antigens can be avoided with the use of epitope-based vaccines.

An additional advantage of an epitope-based vaccine approach is the ability to combine selected epitopes (CTL and HTL), and further, to modify the composition of the epitopes, achieving, for example, enhanced immunogenicity. Accordingly, the immune response can be modulated, as appropriate, for the target disease. Similar engineering of the response is not possible with traditional approaches.

Another major benefit of epitope-based immune-stimulating vaccines is their safety. The possible pathological side effects caused by infectious agents or whole protein antigens, which might have their own intrinsic biological activity, is eliminated.

An epitope-based vaccine also provides the ability to direct and focus an immune response to multiple selected antigens from the same pathogen. Thus, patient-by-patient variability in the immune response to a particular pathogen may be alleviated by inclusion of epitopes from multiple antigens from that pathogen in a vaccine composition. A "pathogen" may be an infectious agent or a tumor associated molecule.

One of the most formidable obstacles to the development of broadly efficacious epitope-based immunotherapeutics, however, has been the extreme polymorphism of HLA molecules. To date, effective non-genetically biased coverage of a population has been a task of considerable complexity; such coverage has required that epitopes be used that are specific for HLA molecules corresponding to each individual HLA allele; impractically large numbers of epitopes would therefore have to be used in order to cover ethnically diverse populations. Thus, there has existed a need for peptide epitopes that are bound by multiple HLA antigen molecules for use in epitope-based vaccines. The greater the number of HLA antigen molecules bound, the greater the breadth of population coverage by the vaccine.

Furthermore, as described herein in greater detail, a need has existed to modulate peptide binding properties, e.g., so that peptides that are able to bind to multiple HLA antigens do so with an affinity that will stimulate an immune response. Identification of epitopes restricted by more than one HLA allele at an affinity that correlates with immunogenicity is important to provide thorough population coverage, and to allow the elicitation of responses of sufficient vigor to prevent or clear an infection in a diverse segment of the population. Such a response can also target a broad array of epitopes. The technology disclosed herein provides for such favored immune responses.

In a preferred embodiment, epitopes for inclusion in vaccine compositions of the invention are selected by a process whereby protein sequences of known antigens are evaluated for the presence of motif or supermotif-bearing epitopes. Peptides corresponding to a motif- or supermotif-bearing epitope are then synthesized and tested for the ability to bind to the HLA molecule that recognizes the selected motif. Those peptides that bind at an intermediate or high affinity i.e., an $IC_{50}$ (or a $K_D$ value) of 500 nM or less for HLA class I molecules or an $IC_{50}$ of 1000 nM or less for HLA class II molecules, are further evaluated for their ability to induce a CTL or HTL response. Immunogenic peptide epitopes are selected for inclusion in vaccine compositions.

Supermotif-bearing peptides may additionally be tested for the ability to bind to multiple alleles within the HLA supertype family. Moreover, peptide epitopes may be analogued to modify binding affinity and/or the ability to bind to multiple alleles within an HLA supertype.

The invention also includes embodiments comprising methods for monitoring or evaluating an immune response to PF in patient having a known HLA-type. Such methods comprise incubating a T cell sample from the patient with a peptide composition comprising an PF epitope consisting essentially of an amino acid sequence described in Tables VII to Table XX or Table XXII which binds the product of at least one HLA allele present in the patient, and detecting for the presence of a T cell that binds to the peptide. A CTL peptide epitope may, for example, be used as a component of a tetrameric complex for such an analysis.

An alternative modality for defining the peptide epitopes in accordance with the invention is to recite the physical properties, such as length; primary structure; or charge, which are correlated with binding to a particular allele-specific HLA molecule or group of allele-specific HLA molecules. A further modality for defining peptide epitopes is to recite the physical properties of an HLA binding pocket, or properties shared by several allele-specific HLA binding pockets (e.g. pocket configuration and charge distribution) and reciting that the peptide epitope fits and binds to said pocket or pockets.

As will be apparent from the discussion below, other methods and embodiments are also contemplated. Further, novel synthetic peptides produced by any of the methods described herein are also part of the invention.

III. BRIEF DESCRIPTION OF THE FIGURES

FIG. 1: FIG. 1 provides a graph of total frequency of genotypes as a function of the number of PF candidate epitopes bound by HLA-A and B molecules, in an average population.

IV. DETAILED DESCRIPTION OF THE INVENTION

The peptide epitopes and corresponding nucleic acid compositions of the present invention are useful for stimulating an immune response to PF by stimulating the production of CTL or HTL responses. The peptide epitopes, which are derived directly or indirectly from native PF protein amino acid sequences, are able to bind to HLA molecules and stimulate an immune response to PF. The complete sequence of the PF proteins to be analyzed can be obtained from Genbank. Peptide epitopes and analogs thereof can also be readily determined from sequence information that may subsequently be discovered for heretofore unknown variants of PF, as will be clear from the disclosure provided below.

The peptide epitopes of the invention have been identified in a number of ways, as will be discussed below. Also discussed in greater detail is that analog peptides have been derived and the binding activity for HLA molecules modulated by modifying specific amino acid residues to create peptide analogs exhibiting altered immunogenicity. Further, the present invention provides compositions and combinations of compositions that enable epitope-based vaccines that are capable of interacting with HLA molecules encoded by various genetic alleles to provide broader population coverage than prior vaccines.

IV.A. DEFINITIONS

The invention can be better understood with reference to the following definitions, which are listed alphabetically:

A "computer" or "computer system" generally includes: a processor; at least one information storage/retrieval apparatus such as, for example, a hard drive, a disk drive or a tape drive; at least one input apparatus such as, for example, a keyboard, a mouse, a touch screen, or a microphone; and a display structure. Additionally, the computer may include a communication channel in communication with a network. Such a computer may include more or less than what is listed above.

"Cross-reactive binding" indicates that a peptide is bound by more than one HLA molecule; a synonym is degenerate binding.

A "cryptic epitope" elicits a response by immunization with an isolated peptide, but the response is not cross-reactive in vitro when intact whole protein which comprises the epitope is used as an antigen.

A "dominant epitope" is an epitope that induces an immune response upon immunization with a whole native antigen (see, e.g., Sercarz, et al., Annu. Rev. Immunol. 11:729-766, 1993). Such a response is cross-reactive in vitro with an isolated peptide epitope.

With regard to a particular amino acid sequence, an "epitope" is a set of amino acid residues which is involved in recognition by a particular immunoglobulin, or in the context of T cells, those residues necessary for recognition by T cell receptor (TCR) proteins and/or Major Histocompatibility Complex (MHC) receptors. In an immune system setting, in vivo or in vitro, an epitope is the collective features of a molecule, such as primary, secondary and tertiary peptide structure, and charge, that together form a site recognized by an immunoglobulin, TCR or HLA molecule. Throughout this disclosure epitope and peptide are often used interchangeably. It is to be appreciated, however, that isolated or purified protein or peptide molecules larger than and comprising an epitope of the invention are still within the bounds of the invention.

"Human Leukocyte Antigen" or "HLA" is a human class I or class II MHC protein (see, e.g., Stites, et al., IMMUNOLOGY, $8^{TH}$ ED., Lange Publishing, Los Altos, Calif. (1994).

An "HLA supertype or family", as used herein, describes sets of HLA molecules grouped on the basis of shared peptide-binding specificities. HLA class I molecules that share somewhat similar binding affinity for peptides bearing certain amino acid motifs are grouped into HLA supertypes. The terms HLA superfamily, HLA supertype family, HLA family, and HLA xx-like molecules (where xx denotes a particular HLA type), are synonyms.

Throughout this disclosure, results are expressed in terms of "$IC_{50}$'s." $IC_{50}$ is the concentration of peptide in a binding assay at which 50% inhibition of binding of a reference peptide is observed. Given the conditions in which the assays are run (i.e., limiting HLA proteins and labeled peptide concentrations), these values approximate $K_D$ values. Assays for determining binding are described in detail, e.g., in PCT publications WO 94/20127 and WO 94/03205. It should be noted that $IC_{50}$ values can change, often dramatically, if the assay conditions are varied, and depending on the particular reagents used (e.g., HLA preparation, etc.). For example, excessive concentrations of HLA molecules will increase the apparent measured $IC_{50}$ of a given ligand.

Alternatively, binding is expressed relative to a reference peptide. Although as a particular assay becomes more, or less, sensitive, the $IC_{50}$'s of the peptides tested may change somewhat, the binding relative to the reference peptide will not significantly change. For example, in an assay run under conditions such that the $IC_{50}$ of the reference peptide increases 10-fold, the $IC_{50}$ values of the test peptides will also shift approximately 10-fold. Therefore, to avoid ambiguities, the assessment of whether a peptide is a good, intermediate, weak, or negative binder is generally based on its $IC_{50}$, relative to the $IC_{50}$ of a standard peptide.

Binding may also be determined using other assay systems including those using: live cells (e.g., Ceppellini et al., Nature 339:392, 1989; Christnick et al., Nature 352:67, 1991; Busch et al., Immunol. 2:443, 1990; Hill et al., J. Immunol. 147:189, 1991; del Guercio et al., J. Immunol. 154:685, 1995), cell free systems using detergent lysates (e.g., Cerundolo et al., J. Immunol. 21:2069, 1991), immobilized purified MHC (e.g., Hill et al., J. Immunol. 152, 2890, 1994; Marshall et al., J. Immunol. 152:4946, 1994), ELISA systems (e.g., Reay et al., EMBO J. 11:2829, 1992), surface plasmon resonance (e.g., Khilko et al., J. Biol. Chem. 268:15425, 1993); high flux soluble phase assays (Hammer et al., J. Exp. Med. 180:2353, 1994), and measurement of class I MHC stabilization or assembly (e.g., Ljunggren et al., Nature 346:476, 1990; Schumacher et al., Cell 62:563, 1990; Townsend et al., Cell 62:285, 1990; Parker et al., J. Immunol. 149:1896, 1992).

As used herein, "high affinity" with respect to HLA class I molecules is defined as binding with an $IC_{50}$, or $K_D$ value, of 50 nM or less; "intermediate affinity" is binding with an $IC_{50}$ or $K_D$ value of between about 50 and about 500 nM. "High affinity" with respect to binding to HLA class II molecules is defined as binding with an $IC_{50}$ or $K_D$ value of 100 nM or less; "intermediate affinity" is binding with an $IC_{50}$ or $K_D$ value of between about 100 and about 1000 nM.

The terms "identical" or percent "identity," in the context of two or more peptide sequences, refer to two or more sequences or subsequences that are the same or have a specified percentage of amino acid residues that are the same, when compared and aligned for maximum correspondence over a comparison window, as measured using a sequence comparison algorithm or by manual alignment and visual inspection.

An "immunogenic peptide" or "peptide epitope" is a peptide that comprises an allele-specific motif or supermotif such that the peptide will bind an HLA molecule and induce a CTL and/or HTL response. Thus, immunogenic peptides of the invention are capable of binding to an appropriate HLA molecule and thereafter inducing a cytotoxic T cell response, or a helper T cell response, to the antigen from which the immunogenic peptide is derived.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment.

"Major Histocompatibility Complex" or "MHC" is a cluster of genes that plays a role in control of the cellular interactions responsible for physiologic immune responses. In humans, the MHC complex is also known as the HLA complex. For a detailed description of the MHC and HLA complexes, see, Paul, FUNDAMENTAL IMMUNOLOGY, $3^{RD}$ ED., Raven Press, New York, 1993.

The term "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs are typically different for each protein encoded by each human HLA allele and differ in the pattern of the primary and secondary anchor residues.

A "negative binding residue" or "deleterious residue" is an amino acid which, if present at certain positions (typically not primary anchor positions) in a peptide epitope, results in decreased binding affinity of the peptide for the peptide's corresponding HLA molecule.

The term "peptide" is used interchangeably with "oligopeptide" in the present specification to designate a series of residues, typically L-amino acids, connected one to the other, typically by peptide bonds between the alpha-amino and carboxyl groups of adjacent amino acids. The preferred CTL-inducing peptides of the invention are 13 residues or less in length and usually consist of between about 8 and about 11 residues, preferably 9 or 10 residues. The preferred HTL-inducing peptides are less than about 50 residues in length and usually consist of between about 6 and about 30 residues, more usually between about 12 and 25, and often between about 15 and 20 residues.

"Pharmaceutically acceptable" refers to a non-toxic, inert, and physiologically compatible composition.

A "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding grooves of an HLA molecule, with their side chains buried in specific pockets of the binding grooves themselves. In one embodiment, for example, the primary anchor residues are located at position 2 (from the amino terminal position) and at the carboxyl terminal position of a 9-residue peptide epitope in accordance with the invention. The primary anchor positions for each motif and supermotif are set forth in Table 1. For example, analog peptides can be created by altering the presence or absence of particular residues in these primary anchor positions. Such analogs are used to modulate the binding affinity of a peptide comprising a particular motif or supermotif.

"Promiscuous recognition" is where a distinct peptide is recognized by the same T cell clone in the context of various HLA molecules. Promiscuous recognition or binding is synonymous with cross-reactive binding.

A "protective immune response" or "therapeutic immune response" refers to a CTL and/or an HTL response to an antigen derived from an infectious agent or a tumor antigen, which prevents or at least partially arrests disease symptoms or progression. The immune response may also include an antibody response which has been facilitated by the stimulation of helper T cells.

The term "residue" refers to an amino acid or amino acid mimetic incorporated into an oligopeptide by an amide bond or amide bond mimetic.

A "secondary anchor residue" is an amino acid at a position other than a primary anchor position in a peptide which may influence peptide binding. A secondary anchor residue occurs at a significantly higher frequency amongst bound peptides than would be expected by random distribution of amino acids at one position. The secondary anchor residues are said to occur at "secondary anchor positions." A secondary anchor residue can be identified as a residue which is present at a higher frequency among high or intermediate affinity binding peptides, or a residue otherwise associated with high or intermediate affinity binding. For example, analog peptides can be created by altering the presence or absence of particular residues in these secondary anchor positions. Such analogs are used to finely modulate the binding affinity of a peptide comprising a particular motif or supermotif.

A "subdominant epitope" is an epitope which evokes little or no response upon immunization with whole antigens which comprise the epitope, but for which a response can be obtained by immunization with an isolated peptide, and this response (unlike the case of cryptic epitopes) is detected when whole protein is used to recall the response in vitro or in vivo.

A "supermotif" is a peptide binding specificity shared by HLA molecules encoded by two or more HLA alleles. Preferably, a supermotif-bearing peptide is recognized with high or intermediate affinity (as defined herein) by two or more HLA antigens.

"Synthetic peptide" refers to a peptide that is not naturally occurring, but is man-made using such methods as chemical synthesis or recombinant DNA technology.

The nomenclature used to describe peptide compounds follows the conventional practice wherein the amino group is presented to the left (the N-terminus) and the carboxyl group to the right (the C-terminus) of each amino acid residue. When amino acid residue positions are referred to in a peptide epitope they are numbered in an amino to carboxyl direction with position one being the position closest to the amino terminal end of the epitope, or the peptide or protein of which it may be a part. In the formulae representing selected specific embodiments of the present invention, the amino- and carboxyl-terminal groups, although not specifically shown, are in the form they would assume at physiologic pH values, unless otherwise specified. In the amino acid structure formulae, each residue is generally represented by standard three letter or single letter designations. The L-form of an amino acid residue is represented by a capital single letter or a capital first letter of a three-letter symbol, and the D-form for those amino acids having D-forms is represented by a lower case single letter or a lower case three letter symbol. Glycine has no asymmetric carbon atom and is simply referred to as "Gly" or G. Symbols for the amino acids are shown below.

| Single Letter Symbol | Three Letter Symbol | Amino Acids |
|---|---|---|
| A | Ala | Alanine |
| C | Cys | Cysteine |
| D | Asp | Aspartic Acid |
| E | Glu | Glutamic Acid |
| F | Phe | Phenylalanine |
| G | Gly | Glycine |
| H | His | Histidine |
| I | Ile | Isoleucine |
| K | Lys | Lysine |
| L | Leu | Leucine |
| M | Met | Methionine |
| N | Asn | Asparagine |
| P | Pro | Proline |
| Q | Gln | Glutamine |
| R | Arg | Arginine |
| S | Ser | Serine |
| T | Thr | Threonine |
| V | Val | Valine |
| W | Trp | Tryptophan |
| Y | Tyr | Tyrosine |

IV.B. STIMULATION OF CTL AND HTL RESPONSES

The mechanism by which T cells recognize antigens has been delineated during the past ten years. Based on our understanding of the immune system we have developed efficacious peptide epitope vaccine compositions that can induce a therapeutic or prophylactic immune response to PF in a broad population. For an understanding of the value and efficacy of the claimed compositions, a brief review of immunology-related technology is provided.

A complex of an HLA molecule and a peptidic antigen acts as the ligand recognized by HLA-restricted T cells (Buus, S. et al., *Cell* 47:1071, 1986; Babbitt, B. P. et al., *Nature* 317: 359, 1985; Townsend, A. and Bodmer, H., *Annu. Rev. Immunol.* 7:601, 1989; Germain, R. N., *Annu. Rev. Immunol.* 11:403, 1993). Through the study of single amino acid substituted antigen analogs and the sequencing of endogenously bound, naturally processed peptides, critical residues that correspond to motifs required for specific binding to HLA antigen molecules have been identified and are described herein and are set forth in Tables I, II, and III (see also, e.g., Southwood, et al., *J. Immunol.* 160:3363, 1998; Rammensee, et al., *Immunogenetics* 41:178, 1995; Rammensee et al., SYFPEITHI, access via web at: http://134.2.96.221/scripts.hla-server.dll/home.htm; Sette, A. and Sidney, J. *Curr. Opin. Immunol.* 10:478, 1998; Engelhard, V. H., *Curr. Opin. Immunol.* 6:13, 1994; Sette, A. and Grey, H. M., *Curr. Opin. Immunol.* 4:79, 1992; Sinigaglia, F. and Hammer, J. *Curr. Biol.* 6:52, 1994; Ruppert et al., *Cell* 74:929-937, 1993; Kondo et al., *J. Immunol.* 155:4307-4312, 1995; Sidney et al., *J. Immunol.* 157:3480-3490, 1996; Sidney et al., *Human Immunol.* 45:79-93, 1996; Sette, A. and Sidney, J. *Immunogenetics, in press,* 1999).

Furthermore, x-ray crystallographic analysis of HLA-peptide complexes has revealed pockets within the peptide binding cleft of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specific HLA binding motifs, or class I or class II supermotifs allows identification of regions within a protein that have the potential of binding particular HLA antigen(s).

The present inventors have found that the correlation of binding affinity with immunogenicity, which is disclosed herein, is an important factor to be considered when evaluating candidate peptides. Thus, by a combination of motif searches and HLA-peptide binding assays, candidates for epitope-based vaccines have been identified. After determining their binding affinity, additional confirmatory work can be performed to select, amongst these vaccine candidates, epitopes with preferred characteristics in terms of population coverage, antigenicity, and immunogenicity.

Various strategies can be utilized to evaluate immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998); This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997); In this method, peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have effectively been vaccinated, recovered from infection, and/or from chronically infected patients (see, e.g., Rehermann, B. et al., *J. Exp. Med.* 181:1047, 1995; Doolan, D. L. et al., *Immunity* 7:97, 1997; Bertoni, R. et al., *J. Clin. Invest.* 100:503, 1997; Threlkeld, S. C. et al., *J. Immunol.* 159:1648, 1997; Diepolder, H. M. et al., *J. Virol.* 71:6011, 1997). In applying this strategy, recall responses are detected by culturing PBL from subjects that have been naturally exposed to the antigen, for instance through infection, and thus have generated an immune response "naturally", or from patients who were vaccinated against the infection. PBL from subjects are cultured in vitro for 1-2 weeks in the presence of test peptide plus antigen presenting cells (APC) to allow activation of "memory" T cells, as compared to "naive" T cells. At the end of the culture period, T cell activity is detected using assays for T cell activity including $^{51}$Cr release involving peptide-sensitized targets, T cell proliferation, or lymphokine release.

The following describes the peptide epitopes and corresponding nucleic acids of the invention.

IV.C. BINDING AFFINITY OF PEPTIDE EPITOPES FOR HLA MOLECULES

As indicated herein, the large degree of HLA polymorphism is an important factor to be taken into account with the epitope-based approach to vaccine development. To address this factor, epitope selection encompassing identification of peptides capable of binding at high or intermediate affinity to multiple HLA molecules is preferably utilized, most preferably these epitopes bind at high or intermediate affinity to two or more allele-specific HLA molecules.

CTL-inducing peptides of interest for vaccine compositions preferably include those that have an $IC_{50}$ or binding affinity value for class I HLA molecules of 500 nM or better (i.e., the value is ≤500 nM). HTL-inducing peptides preferably include those that have an $IC_{50}$ or binding affinity value for class II HLA molecules of 1000 nM or better, (i.e., the value is ≤1,000 nM). For example, peptide binding is assessed by testing the capacity of a candidate peptide to bind to a purified HLA molecule in vitro. Peptides exhibiting high or intermediate affinity are then considered for further analysis. Selected peptides are tested on other members of the supertype family. In preferred embodiments, peptides that exhibit cross-reactive binding are then used in cellular screening analyses or vaccines.

As disclosed herein, higher HLA binding affinity is correlated with greater immunogenicity. Greater immunogenicity can be manifested in several different ways. Immunogenicity corresponds to whether an immune response is elicited at all, and to the vigor of any particular response, as well as to the extent of a population in which a response is elicited. For example, a peptide might elicit an immune response in a diverse array of the population, yet in no instance produce a vigorous response. In accordance with these principles, close to 90% of high binding peptides have been found to be immunogenic, as contrasted with about 50% of the peptides which bind with intermediate affinity. Moreover, higher binding affinity peptides leads to more vigorous immunogenic responses. As a result, less peptide is required to elicit a similar biological effect if a high affinity binding peptide is used. Thus, in preferred embodiments of the invention, high affinity binding epitopes are particularly useful.

The relationship between binding affinity for HLA class I molecules and immunogenicity of discrete peptide epitopes on bound antigens has been determined for the first time in the art by the present inventors. The correlation between binding affinity and immunogenicity was analyzed in two different experimental approaches (see, e.g., Sette, et al., *J. Immunol.* 153:5586-5592, 1994). In the first approach, the immunogenicity of potential epitopes ranging in HLA binding affinity over a 10,000-fold range was analyzed in HLA-A*0201 transgenic mice. In the second approach, the antigenicity of approximately 100 different hepatitis B virus (HBV)-derived potential epitopes, all carrying A*0201 binding motifs, was assessed by using PBL from acute hepatitis patients. Pursuant to these approaches, it was determined that an affinity threshold value of approximately 500 nM (preferably 50 nM or less) determines the capacity of a peptide epitope to elicit a CTL response. These data are true for class I binding affinity measurements for naturally processed peptides and for synthesized T cell epitopes. These data also indicate the important role of determinant selection in the shaping of T cell responses (see, e.g., Schaeffer et al. *Proc. Natl. Acad. Sci. USA* 86:4649-4653, 1989).

An affinity threshold associated with immunogenicity in the context of HLA class II DR molecules has also been delineated (see, e.g., Southwood et al. *J. Immunology* 160: 3363-3373, 1998, and U.S. Ser. No. 09/009,953 filed Jan. 21, 1998, now U.S. Pat. No. 6,413,517). In order to define a biologically significant threshold of DR binding affinity, a database of the binding affinities of 32 DR-restricted epitopes for their restricting element (i.e., the HLA molecule that binds the motif) was compiled. In approximately half of the cases (15 of 32 epitopes), DR restriction was associated with high binding affinities, i.e. binding affinity values of 100 nM or less. In the other half of the cases (16 of 32), DR restriction was associated with intermediate affinity (binding affinity values in the 100-1000 nM range). In only one of 32 cases was DR restriction associated with an $IC_{50}$ of 1000 nM or greater. Thus, 1000 nM can be defined as an affinity threshold associated with immunogenicity in the context of DR molecules.

The binding affinity of peptides for HLA molecules can be determined as described in Example 1, below.

IV.D. PEPTIDE EPITOPE BINDING MOTIFS AND SUPERMOTIFS

Through the study of single amino acid substituted antigen analogs and the sequencing of endogenously bound, naturally processed peptides, critical residues required for allele-specific binding to HLA molecules have been identified. The presence of these residues correlates with binding affinity for HLA molecules. The identification of motifs and/or supermotifs that correlate with high and intermediate affinity binding is an important issue with respect to the identification of immunogenic peptide epitopes for the inclusion in a vaccine. Kast et al. (*J. Immunol.* 152:3904-3912, 1994) have shown that motif-bearing peptides account for 90% of the epitopes that bind to allele-specific HLA class I molecules. In this study all possible peptides of 9 amino acids in length and overlapping by eight amino acids (240 peptides), which cover the entire sequence of the E6 and E7 proteins of human papillomavirus type 16, were evaluated for binding to five allele-specific HLA molecules that are expressed at high frequency among different ethnic groups. This unbiased set of peptides allowed an evaluation of the predictive value of HLA class I motifs. From the set of 240 peptides, 22 peptides were identified that bound to an allele-specific HLA molecule with high or intermediate affinity. Of these 22 peptides, 20 (i.e. 91%) were motif-bearing. Thus, this study demonstrates the value of motifs for the identification of peptide epitopes for inclusion in a vaccine: application of motif-based identification techniques will identify about 90% of the potential epitopes in a target antigen protein sequence.

Such peptide epitopes are identified in the Tables described below.

Peptides of the present invention may also comprise epitopes that bind to MHC class II DR molecules. A greater degree of heterogeneity in both size and binding frame position of the motif, relative to the N and C termini of the peptide, exists for class II peptide ligands. This increased heterogeneity of HLA class II peptide ligands is due to the structure of the binding groove of the HLA class II molecule which, unlike its class I counterpart, is open at both ends. Crystallographic analysis of HLA class II DRB*0101-peptide complexes showed that the major energy of binding is contributed by peptide residues complexed with complementary pockets on the DRB*0101 molecules. An important anchor residue engages the deepest hydrophobic pocket (see, e.g., Madden, D. R. *Ann. Rev. Immunol.* 13:587, 1995) and is referred to as position 1 (P1). P1 may represent the N-terminal residue of a class II binding peptide epitope, but more typically is flanked towards the N-terminus by one or more residues. Other studies have also pointed to an important role for the peptide residue in the $6^{th}$ position towards the C-terminus, relative to P1, for binding to various DR molecules.

In the past few years evidence has accumulated to demonstrate that a large fraction of HLA class I and class II molecules can be classified into a relatively few supertypes, each characterized by largely overlapping peptide binding repertoires, and consensus structures of the main peptide binding pockets. Thus, peptides of the present invention are identified by any one of several HLA-specific amino acid motifs (see, e.g., Tables I-III), or if the presence of the motif corresponds to the ability to bind several allele-specific HLA antigens, a supermotif. The HLA molecules that bind to peptides that possess a particular amino acid supermotif are collectively referred to as an HLA "supertype."

The peptide motifs and supermotifs described below, and summarized in Tables I-III, provide guidance for the identification and use of peptide epitopes in accordance with the invention.

Examples of peptide epitopes bearing a respective supermotif or motif are included in Tables as designated in the description of each motif or supermotif below. The Tables include a binding affinity ratio listing for some of the peptide epitopes. The ratio may be converted to $IC_{50}$ by using the following formula: $IC_{50}$ of the standard peptide/ratio=$IC_{50}$ of the test peptide (i.e., the peptide epitope). The $IC_{50}$ values of standard peptides used to determine binding affinities for Class I peptides are shown in Table IV. The $IC_{50}$ values of standard peptides used to determine binding affinities for Class II peptides are shown in Table V. The peptides used as standards for the binding assays described herein are examples of standards; alternative standard peptides can also be used when performing binding analyses.

To obtain the peptide epitope sequences listed in each Table, protein sequence data for four *P. falciparum* antigens were evaluated for the presence of the designated supermotif or motif. These antigens are: EXP-1, LSA-1, SSP2, and CSP. Nineteen sequences were available for CSP, 10 sequences were available for SSP, and one sequence each was available for EXP-1 and LSA-1. Peptide epitopes were additionally evaluated on the basis of their conservancy among the protein sequences for the PF antigens for which multiple sequences were available. A criterion for conservancy requires that the entire sequence of an HLA class I binding peptide be totally (i.e., 100%) conserved in 79% of the sequences available for a specific protein. Similarly, a criterion for conservancy requires that the entire 9-mer core region of an HLA class II binding peptide be totally conserved in 79% of the sequences available for a specific protein. The percent conservancy of the selected peptide epitopes is indicated on the Tables. The frequency, i.e. the number of sequences of the PF protein antigen in which the totally conserved peptide sequence was identified, is also shown. The "pos" (position) column in the Tables designates the amino acid position in the PF protein that corresponds to the first amino acid residue of the epitope. The "number of amino acids" indicates the number of residues in the epitope sequence.

HLA Class I Motifs Indicative of CTL Inducing Peptide Epitopes:

The primary anchor residues of the HLA class I peptide epitope supermotifs and motifs delineated below are summarized in Table I. The HLA class I motifs set out in Table I(a) are those most particularly relevant to the invention claimed here. Primary and secondary anchor positions are summarized in Table II. Allele-specific HLA molecules that comprise HLA class I supertype families are listed in Table VI. In some cases, peptide epitopes may be listed in both a motif and a supermotif Table. The relationship of a particular motif and respective supermotif is indicated in the description of the individual motifs.

IV.D.1. HLA-A1 Supermotif

The HLA-A1 supermotif is characterized by the presence in peptide ligands of a small (T or S) or hydrophobic (L, I, V, or M) primary anchor residue in position 2, and an aromatic (Y, F, or W) primary anchor residue at the C-terminal position of the epitope (see, e.g., Sette and Sidney, *Immunogenetics*, in press, 1999). The corresponding family of HLA molecules that bind to the A1 supermotif (i.e., the HLA-A1 supertype) is comprised of at least A*0101, A*2601, A*2602, A*2501, and A*3201 (see, e.g., DiBrino, M. et al., *J. Immunol.* 151:5930, 1993; DiBrino, M. et al., *J. Immunol.* 152:620, 1994; Kondo, A. et al., *Immunogenetics* 45:249, 1997). Other allele-specific HLA molecules predicted to be members of the A1 supertype are shown in Table VI. Peptides binding to each of the individual HLA proteins can be modulated by substitutions at primary and/or secondary anchor positions, preferably choosing respective residues specified for the supermotif.

Representative peptide epitopes that comprise the A1 supermotif are set forth on the attached Table VII.

IV.D.2. HLA-A2 Supermotif

Primary anchor specificities for allele-specific HLA-A2.1 molecules (see, e.g., Falk et al., *Nature* 351:290-296, 1991; Hunt et al., *Science* 255:1261-1263, 1992; Parker et al., *J. Immunol.* 149:3580-3587, 1992; Ruppert et al., *Cell* 74:929-937, 1993) and cross-reactive binding among HLA-A2 and -A28 molecules have been described. (See, e.g., Fruci et al., *Human Immunol.* 38:187-192, 1993; Tanigaki et al., *Human Immunol.* 39:155-162, 1994; Del Guercio et al., *J. Immunol.* 154:685-693, 1995; Kast et al., *J. Immunol.* 152:3904-3912, 1994 for reviews of relevant data.) These primary anchor residues define the HLA-A2 supermotif; which presence in peptide ligands corresponds to the ability to bind several different HLA-A2 and -A28 molecules. The HLA-A2 supermotif comprises peptide ligands with L, I, V, M, A, T, or Q as a primary anchor residue at position 2 and L, I, V, M, A, or T as a primary anchor residue at the C-terminal position of the epitope.

The corresponding family of HLA molecules (i.e., the HLA-A2 supertype that binds these peptides) is comprised of at least: A*0201, A*0202, A*0203, A*0204, A*0205, A*0206, A*0207, A*0209, A*0214, A*6802, and A*6901. Other allele-specific HLA molecules predicted to be members of the A2 supertype are shown in Table VI. As explained in detail below, binding to each of the individual allele-specific HLA molecules can be modulated by substitutions at the primary anchor and/or secondary anchor positions, preferably choosing respective residues specified for the supermotif.

Representative peptide epitopes that comprise an A2 supermotif are set forth on the attached Table VIII. The motifs comprising the primary anchor residues V, A, T, or Q at position 2 and L, I, V, A, or T at the C-terminal position are those most particularly relevant to the invention claimed herein.

IV.D.3. HLA-A3 Supermotif

The HLA-A3 supermotif is characterized by the presence in peptide ligands of A, L, I, V, M, S, or, T as a primary anchor at position 2, and a positively charged residue, R or K, at the C-terminal position of the epitope, e.g., in position 9 of 9-mers (see, e.g., Sidney et al., *Hum. Immunol.* 45:79, 1996). Exemplary members of the corresponding family of HLA molecules (the HLA-A3 supertype) that bind the A3 supermotif include at least A*0301, A*1101, A*3101, A*3301, and A*6801. Other allele-specific HLA molecules predicted to be members of the A3 supertype are shown in Table VI. As explained in detail below, peptide binding to each of the individual allele-specific HLA proteins can be modulated by substitutions of amino acids at the primary and/or secondary anchor positions of the peptide, preferably choosing respective residues specified for the supermotif.

Representative peptide epitopes that comprise the A3 supermotif are set forth on the attached Table IX.

IV.D.4. HLA-A24 Supermotif

The HLA-A24 supermotif is characterized by the presence in peptide ligands of an aromatic (F, W, or Y) or hydrophobic aliphatic (L, I, V, M, or T) residue as a primary anchor in position 2, and Y, F, W, L, I, or M as primary anchor at the C-terminal position of the epitope (see, e.g., Sette and Sidney, *Immunogenetics*, in press, 1999). The corresponding family of HLA molecules that bind to the A24 supermotif (i.e., the A24 supertype) includes at least A*2402, A*3001, and A*2301. Other allele-specific HLA molecules predicted to be members of the A24 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the A24 supermotif are set forth on the attached Table X.

IV.D.5. HLA-B7 Supermotif

The HLA-B7 supermotif is characterized by peptides bearing proline in position 2 as a primary anchor, and a hydrophobic or aliphatic amino acid (L, I, V, M, A, F, W, or Y) as the primary anchor at the C-terminal position of the epitope. The corresponding family of HLA molecules that bind the B7 supermotif (i.e., the HLA-B7 supertype) is comprised of at least twenty six HLA-B proteins including: B*0702, B*0703, B*0704, B*0705, B*1508, B*3501, B*3502, B*3503, B*3504, B*3505, B*3506, B*3507, B*3508, B*5101, B*5102, B*5103, B*5104, B*5105, B*5301, B*5401, B*5501, B*5502, B*5601, B*5602, B*6701, and B*7801 (see, e.g., Sidney, et al., *J. Immunol.* 154:247, 1995; Barber, et al., *Curr. Biol.* 5:179, 1995; Hill, et al., *Nature* 360:434, 1992; Rammensee, et al., *Immunogenetics* 41:178, 1995 for reviews of relevant data). Other allele-specific HLA molecules predicted to be members of the B7 supertype are shown in Table VI. As explained in detail below, peptide binding to each of the individual allele-specific HLA proteins can be modulated by substitutions at the primary and/or secondary anchor positions of the peptide, preferably choosing respective residues specified for the supermotif.

Representative peptide epitopes that comprise the B7 supermotif are set forth on the attached Table XI.

IV.D.6. HLA-B27 Supermotif

The HLA-B27 supermotif is characterized by the presence in peptide ligands of a positively charged (R, H, or K) residue as a primary anchor at position 2, and a hydrophobic (F, Y, L, W, M, I, A, or V) residue as a primary anchor at the C-terminal position of the epitope (see, e.g., Sidney and Sette, *Immunogenetics,* in press, 1999). Exemplary members of the corresponding family of HLA molecules that bind to the B27 supermotif (i.e., the B27 supertype) include at least B*1401, B*1402, B*1509, B*2702, B*2703, B*2704, B*2705, B*2706, B*3801, B*3901, B*3902, and B*7301. Other allele-specific HLA molecules predicted to be members of the B27 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the B27 supermotif are set forth on the attached Table XII.

IV.D.7. HLA-B44 Supermotif

The HLA-B44 supermotif is characterized by the presence in peptide ligands of negatively charged (D or E) residues as a primary anchor in position 2, and hydrophobic residues (F, W, Y, L, I, M, V, or A) as a primary anchor at the C-terminal position of the epitope (see, e.g., Sidney et al., *Immunol. Today* 17:261, 1996). Exemplary members of the corresponding family of HLA molecules that bind to the B44 supermotif (i.e., the B44 supertype) include at least: B*1801, B*1802, B*3701, B*4001, B*4002, B*4006, B*4402, B*4403, and B*4006. Peptide binding to each of the allele-specific HLA molecules can be modulated by substitutions at primary and/ or secondary anchor positions; preferably choosing respective residues specified for the supermotif.

IV.D.8. HLA-B58 Supermotif

The HLA-B58 supermotif is characterized by the presence in peptide ligands of a small aliphatic residue (A, S, or T) as a primary anchor residue at position 2, and an aromatic or hydrophobic residue (F, W, Y, L, I, V, M, or A) as a primary anchor residue at the C-terminal position of the epitope (see, e.g., Sidney and Sette, *Immunogenetics,* in press, 1999 for reviews of relevant data). Exemplary members of the corresponding family of HLA molecules that bind to the B58 supermotif (i.e., the B58 supertype) include at least: B*1516, B*1517, B*5701, B*5702, and B*5801. Other allele-specific HLA molecules predicted to be members of the B58 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the B58 supermotif are set forth on the attached Table XIII.

IV.D.9. HLA-B62 Supermotif

The HLA-B62 supermotif is characterized by the presence in peptide ligands of the polar aliphatic residue Q or a hydrophobic aliphatic residue (L, V, M, I, or P) as a primary anchor in position 2, and a hydrophobic residue (F, W, Y, M, I, V, L, or A) as a primary anchor at the C-terminal position of the epitope (see, e.g., Sidney and Sette, *Immunogenetics,* in press, 1999). Exemplary members of the corresponding family of HLA molecules that bind to the B62 supermotif (i.e., the B62 supertype) include at least: B*1501, B*1502, B*1513, and B5201. Other allele-specific HLA molecules predicted to be members of the B62 supertype are shown in Table VI. Peptide binding to each of the allele-specific HLA molecules can be modulated by substitutions at primary and/or secondary anchor positions, preferably choosing respective residues specified for the supermotif.

Representative peptide epitopes that comprise the B62 supermotif are set forth on the attached Table XIV.

IV.D.10. HLA-A1 Motif

The HLA-A1 motif is characterized by the presence in peptide ligands of T, S, or M as a primary anchor residue at position 2 and the presence of Y as a primary anchor residue at the C-terminal position of the epitope. An alternative allele-specific A1 motif is characterized by a primary anchor residue at position 3 rather than position 2. This motif is characterized by the presence of D, E, A, or S as a primary anchor residue in position 3, and a Y as a primary anchor residue at the C-terminal position of the epitope (see, e.g., DiBrino et al., *J. Immunol.,* 152:620, 1994; Kondo et al., *Immunogenetics* 45:249, 1997; and Kubo et al., *J. Immunol.* 152:3913, 1994 for reviews of relevant data). Peptide binding to HLA A1 can be modulated by substitutions at primary and/or secondary anchor positions, preferably choosing respective residues specified for the motif.

Representative peptide epitopes that comprise either A1 motif are set forth on the attached Table XV. Those epitopes comprising T, S, or M at position 2 and Y at the C-terminal position are also included in the listing of HLA-A1 supermotif-bearing peptide epitopes listed in Table VII, as these residues are a subset of the A1 supermotif primary anchors.

IV.D.11. HLA-A*0201 Motif

An HLA-A2*0201 motif was determined to be characterized by the presence in peptide ligands of L or M as a primary anchor residue in position 2, and L or V as a primary anchor residue at the C-terminal position of a 9-residue peptide (see, e.g., Falk et al., *Nature* 351:290-296, 1991) and was further found to comprise an I at position 2 and I or A at the C-terminal position of a nine amino acid peptide (see, e.g., Hunt et al., *Science* 255:1261-1263, Mar. 6, 1992; Parker et al., *J. Immunol.* 149:3580-3587, 1992). The A*0201 allele-specific motif has also been defined by the present inventors to additionally comprise V, A, T, or Q as a primary anchor residue at position 2, and M or T as a primary anchor residue at the C-terminal position of the epitope (see, e.g., Kast et al., *J. Immunol.* 152:3904-3912, 1994). Thus, the HLA-A*0201 motif comprises peptide ligands with L, I, V, M, A, T, or Q as primary anchor residues at position 2 and L, I, V, M, A, or T as a primary anchor residue at the C-terminal position of the epitope. The preferred and tolerated residues that characterize the primary anchor positions of the HLA-A*0201 motif are identical to the residues describing the A2 supermotif. (For reviews of relevant data, see, e.g., Del Guercio et al., *J. Immunol.* 154:685-693, 1995; Ruppert et al., *Cell* 74:929-937, 1993; Sidney et al., *Immunol. Today* 17:261-266, 1996; Sette and Sidney, *Curr. Opin. in Immunol.* 10:478-482, 1998). Secondary anchor residues that characterize the A*0201 motif have additionally been defined (see, e.g., Ruppert et al., *Cell* 74:929-937, 1993). These are shown in Table II. Peptide binding to HLA-A*0201 molecules can be modulated by substitutions at primary and/or secondary anchor positions, preferably choosing respective residues specified for the motif.

Representative peptide epitopes that comprise an A*0201 motif are set forth on the attached Table VIII. The A*0201 motifs comprising the primary anchor residues V, A, T, or Q at position 2 and L, I, V, A, or T at the C-terminal position are those most particularly relevant to the invention claimed herein IV.D.12. HLA-A3 Motif The HLA-A3 motif is characterized by the presence in peptide ligands of L, M, V, I, S, A, T, F, C, G, or D as a primary anchor residue at position 2, and the presence of K, Y, R, H, F, or A as a primary anchor residue at the C-terminal position of the epitope (see, e.g., DiBrino et al., *Proc. Natl. Acad. Sci USA* 90:1508, 1993; and Kubo et al., *J. Immunol.* 152:3913-3924, 1994). Peptide binding to HLA-A3 can be modulated by substitutions at primary and/or secondary anchor positions, preferably choosing respective residues specified for the motif.

Representative peptide epitopes that comprise the A3 motif are set forth on the attached Table XVI. Those peptide epitopes that also comprise the A3 supermotif are also listed in Table IX. The A3 supermotif primary anchor residues comprise a subset of the A3- and A11-allele specific motif primary anchor residues.

IV.D.13. HLA-A11 Motif

The HLA-A11 motif is characterized by the presence in peptide ligands of V, T, M, L, I, S, A, G, N, C, D, or F as a primary anchor residue in position 2, and K, R, Y, or H as a primary anchor residue at the C-terminal position of the epitope (see, e.g., Zhang et al., *Proc. Natl. Acad. Sci USA* 90:2217-2221, 1993; and Kubo et al., *J. Immunol.* 152:3913-3924, 1994). Peptide binding to HLA-A11 can be modulated by substitutions at primary and/or secondary anchor positions, preferably choosing respective residues specified for the motif.

Representative peptide epitopes that comprise the A11 motif are set forth on the attached Table XVII; peptide epitopes comprising the A3 allele-specific motif are also present in this Table because of the extensive overlap between the A3 and A11 motif primary anchor specificities. Further, those peptide epitopes that comprise the A3 supermotif are also listed in Table IX.

IV.D.14. HLA-A24 Motif

The HLA-A24 motif is characterized by the presence in peptide ligands of Y, F, W, or M as a primary anchor residue in position 2, and F, L, I, or W as a primary anchor residue at the C-terminal position of the epitope (see, e.g., Kondo et al., *J. Immunol.* 155:4307-4312, 1995; and Kubo et al., *J. Immunol.* 152:3913-3924, 1994). Peptide binding to HLA-A24 molecules can be modulated by substitutions at primary and/or secondary anchor positions; preferably choosing respective residues specified for the motif.

Representative peptide epitopes that comprise the A24 motif are set forth on the attached Table XVIII. These epitopes are also listed in Table X, which sets forth HLA-A24-supermotif-bearing peptide epitopes, as the primary anchor residues characterizing the A24 allele-specific motif comprise a subset of the A24 supermotif primary anchor residues.

Motifs Indicative of Class II HTL Inducing Peptide Epitopes

The primary and secondary anchor residues of the HLA class II peptide epitope supermotifs and motifs delineated below are summarized in Table III.

IV.D.15. HLA DR-1-4-7 Supermotif

Motifs have also been identified for peptides that bind to three common HLA class II allele-specific HLA molecules: HLA DRB1*0401, DRB1*0101, and DRB1*0701 (see, e.g., the review by Southwood et al. *J. Immunology* 160:3363-3373, 1998). Collectively, the common residues from these motifs delineate the HLA DR-1-4-7 supermotif. Peptides that bind to these DR molecules carry a supermotif characterized by a large aromatic or hydrophobic residue (Y, F, W, L, I, V, or M) as a primary anchor residue in position 1, and a small, non-charged residue (S, T, C, A, P, V, I, L, or M) as a primary anchor residue in position 6 of a 9-mer core region. Allele-specific secondary effects and secondary anchors for each of these HLA types have also been identified (Southwood et al., supra). These are set forth in Table III. Peptide binding to HLA-DRB1*0401, DRB1*0101, and/or DRB1*0701 can be modulated by substitutions at primary and/or secondary anchor positions, preferably choosing respective residues specified for the supermotif.

Conserved 9-mer core regions (i.e., sequences that are 100% conserved in at least 79% of the PF antigen protein sequences used for the analysis), comprising the DR-1-4-7 supermotif, wherein position 1 of the supermotif is at position 1 of the nine-residue core, are set forth in Table XIXa. Respective exemplary peptide epitopes of 15 amino acid residues in length, each of which comprise a conserved nine residue core, are also shown in section "a" of the Table. Cross-reactive binding data for exemplary 15-residue supermotif-bearing peptides are shown in Table XIXb.

IV.D.16. HLA DR3 Motifs

Two alternative motifs (i.e., submotifs) characterize peptide epitopes that bind to HLA-DR3 molecules (see, e.g., Geluk et al., *J. Immunol.* 152:5742, 1994). In the first motif (submotif DR3A) a large, hydrophobic residue (L, I, V, M, F, or Y) is present in anchor position 1 of a 9-mer core, and D is present as an anchor at position 4, towards the carboxyl terminus of the epitope. As in other class II motifs, core position 1 may or may not occupy the peptide N-terminal position.

The alternative DR3 submotif provides for lack of the large, hydrophobic residue at anchor position 1, and/or lack of the negatively charged or amide-like anchor residue at position 4, by the presence of a positive charge at position 6 towards the carboxyl terminus of the epitope. Thus, for the alternative allele-specific DR3 motif (submotif DR3B): L, I, V, M, F, Y, A, or Y is present at anchor position 1; D, N, Q, E, S, or T is present at anchor position 4; and K, R, or H is present at anchor position 6. Peptide binding to HLA-DR3 can be modulated by substitutions at primary and/or secondary anchor positions, preferably choosing respective residues specified for the motif.

Conserved 9-mer core regions (i.e., those sequences that are 100% conserved in at least 79% of the PF antigen protein sequences used for the analysis) corresponding to a nine residue sequence comprising the DR3A submotif (wherein position 1 of the motif is at position 1 of the nine residue core) are set forth in Table XXa. Respective exemplary peptide epitopes of 15 amino acid residues in length, each of which comprise a conserved nine residue core, are also shown in Table XXa. Table XXb shows binding data of exemplary DR3 submotif A-bearing peptides.

Conserved 9-mer core regions (i.e., those that are 100% conserved in at least 79% conserved in the PF antigen protein sequences used for the analysis) comprising the DR3B submotif and respective exemplary 15-mer peptides comprising the DR3 submotif-B epitope are set forth in Table XXc. Table XXd shows binding data of exemplary DR3 submotif B-bearing peptides.

Each of the HLA class I or class II peptide epitopes set out in the Tables herein are deemed singly to be an inventive aspect of this application. Further, it is also an inventive aspect of this application that each peptide epitope may be used in combination with any other peptide epitope.

IV.E. ENHANCING POPULATION COVERAGE OF THE VACCINE

Vaccines that have broad population coverage are preferred because they are more commercially viable and generally applicable to the most people. Broad population coverage can be obtained using the peptides of the invention (and nucleic acid compositions that encode such peptides) through selecting peptide epitopes that bind to HLA alleles which, when considered in total, are present in most of the population. Table XXI lists the overall frequencies of the HLA class I supertypes in various ethnicities (Table XXIa) and the combined population coverage achieved by the A2-, A3-, and B7-supertypes (Table XXIb). The A2-, A3-, and B7 supertypes are each present on the average of over 40% in each of these five major ethnic groups. Coverage in excess of 80% is achieved with a combination of these supermotifs. These results suggest that effective and non-ethnically biased population coverage is achieved upon use of a limited number of cross-reactive peptides. Although the population coverage reached with these three main peptide specificities is high, coverage can be expanded to reach 95% population coverage and above, and more easily achieve truly multispecific responses upon use of additional supermotif or allele-specific motif bearing peptides.

The B44-, A1-, and A24-supertypes are present, on average, in a range from 25% to 40% in these major ethnic populations (Table XXIa). While less prevalent overall, the B27-, B58-, and B62 supertypes are each present with a frequency >25% in at least one major ethnic group (Table XXIa). Table XXIb summarizes the estimated prevalence of combinations of HLA supertypes that have been identified in five major ethnic groups. The incremental coverage obtained by the inclusion of A1-, A24-, and B44-supertypes with the A2, A3, and B7 coverage and coverage obtained with all of the supertypes described herein, is shown.

The data presented herein, together with the previous definition of the A2-, A3-, and B7-supertypes, indicates that all antigens, with the possible exception of A29, B8, and B46, can be classified into a total of nine HLA supertypes. By including epitopes from the six most frequent supertypes, an average population coverage of 99% is obtained for five major ethnic groups.

IV.F. IMMUNE RESPONSE-STIMULATING PEPTIDE ANALOGS

In general, CTL and HTL responses are not directed against all possible epitopes. Rather, they are restricted to a few "immunodominant" determinants (Zinkernagel, et al., *Adv. Immunol.* 27:5159, 1979; Bennink, et al., *J. Exp. Med.* 168:19351939, 1988; Rawle, et al., *J. Immunol.* 146:3977-3984, 1991). It has been recognized that immunodominance (Benacerraf, et al., *Science* 175:273-279, 1972) could be explained by either the ability of a given epitope to selectively bind a particular HLA protein (determinant selection theory) (Vitiello, et al., *J. Immunol.* 131:1635, 1983); Rosenthal, et al., *Nature* 267:156-158, 1977), or to be selectively recognized by the existing TCR (T cell receptor) specificities (repertoire theory) (Klein, J., IMMUNOLOGY, THE SCIENCE OF SELFNON-SELF DISCRIMINATION, John Wiley & Sons, New York, pp. 270-310, 1982). It has been demonstrated that additional factors, mostly linked to processing events, can also play a key role in dictating, beyond strict immunogenicity, which of the many potential determinants will be presented as immunodominant (Sercarz, et al., *Annu. Rev. Immunol.* 11:729-766, 1993).

The concept of dominance and subdominance is relevant to immunotherapy of both infectious diseases and cancer. For example, in the course of chronic infectious disease, recruitment of subdominant epitopes can be important for successful clearance of the infection, especially if dominant CTL or HTL specificities have been inactivated by functional tolerance, suppression, mutation of viruses and other mechanisms (Franco, et al., *Curr. Opin. Immunol.* 7:524-531, 1995). In the case of cancer and tumor antigens, CTLs recognizing at least some of the highest binding affinity peptides might be functionally inactivated. Lower binding affinity peptides are preferentially recognized at these times, and may therefore be preferred in therapeutic or prophylactic anti-cancer vaccines.

In particular, it has been noted that a significant number of epitopes derived from known non-viral tumor associated antigens (TAA) bind HLA class I with intermediate affinity ($IC_{50}$ in the 50-500 nM range). For example, it has been found that 8 of 15 known TAA peptides recognized by tumor infiltrating lymphocytes (TIL) or CTL bound in the 50-500 nM range. (These data are in contrast with estimates that 90% of known viral antigens were bound by HLA class I molecules with $IC_{50}$ of 50 nM or less, while only approximately 10% bound in the 50-500 nM range (Sette, et al., *J. Immunol.*, 153:558-5592, 1994). In the cancer setting this phenomenon is probably due to elimination or functional inhibition of the CTL recognizing several of the highest binding peptides, presumably because of T cell tolerization events.

Without intending to be bound by theory, it is believed that because T cells to dominant epitopes may have been clonally deleted, selecting subdominant epitopes may allow existing T cells to be recruited, which will then lead to a therapeutic or prophylactic response. However, the binding of HLA molecules to subdominant epitopes is often less vigorous than to dominant ones. Accordingly, there is a need to be able to modulate the binding affinity of particular immunogenic epitopes for one or more HLA molecules, and thereby to modulate the immune response elicited by the peptide, for example to prepare analog peptides which elicit a more vigorous response. This ability would greatly enhance the usefulness of peptide epitope-based vaccines and therapeutic agents.

Although peptides with suitable cross-reactivity among all alleles of a superfamily are identified by the screening procedures described above, cross-reactivity is not always as complete as possible, and in certain cases procedures to increase cross-reactivity of peptides can be useful; moreover, such procedures can also be used to modify other properties of the peptides such as binding affinity or peptide stability. Having established the general rules that govern cross-reactivity of peptides for HLA alleles within a given motif or supermotif, modification (i.e., analoging) of the structure of peptides of particular interest in order to achieve broader (or otherwise modified) HLA binding capacity can be performed. More specifically, peptides which exhibit the broadest cross-reactivity patterns, can be produced in accordance with the teachings herein. The present concepts related to analog generation are set forth in greater detail in U.S. Ser. No. 09/226,775 filed Jan. 6, 1999, now abandoned.

In brief, the strategy employed utilizes the motifs or supermotifs which correlate with binding to certain HLA molecules. The motifs or supermotifs are defined by having primary anchors, and in many cases secondary anchors. Analog peptides can be created by substituting amino acid residues at primary anchor, secondary anchor, or at primary and secondary anchor positions. Generally, analogs are made for peptides that already bear a motif or supermotif. Preferred secondary anchor residues of supermotifs and motifs that have been defined for HLA class I and class II binding peptides are shown in Tables II and III, respectively.

For a number of the motifs or supermotifs in accordance with the invention, residues are defined which are deleterious to binding to allele-specific HLA molecules or members of HLA supertypes that bind the respective motif or supermotif (Tables II and III). Accordingly, removal of such residues that are detrimental to binding can be performed in accordance with the present invention. For example, in the case of the A3 supertype, when all peptides that have such deleterious residues are removed from the population of peptides used for the analysis, the incidence of cross-reactivity increased from 22% to 37% (see, e.g., Sidney, J. et al., *Hu. Immunol.* 45:79, 1996). Thus, one strategy to improve the cross-reactivity of peptides within a given supermotif is simply to delete one or more of the deleterious residues present within a peptide and substitute a small "neutral" residue such as Ala (that may not influence T cell recognition of the peptide). An enhanced likelihood of cross-reactivity is expected if, together with elimination of detrimental residues within a peptide, "preferred" residues associated with high affinity binding to an allele-specific HLA molecule or to multiple HLA molecules within a superfamily are inserted.

To ensure that an analog peptide, when used as a vaccine, actually elicits a CTL response to the native epitope in vivo (or, in the case of class II epitopes, elicits helper T cells that cross-react with the wild type peptides), the analog peptide may be used to immunize T cells in vitro from individuals of the appropriate HLA allele. Thereafter, the immunized cells' capacity to induce lysis of wild type peptide sensitized target cells is evaluated. It will be desirable to use as antigen presenting cells, cells that have been either infected, or transfected with the appropriate genes, or, in the case of class II epitopes only, cells that have been pulsed with whole protein antigens, to establish whether endogenously produced antigen is also recognized by the relevant T cells.

Another embodiment of the invention is to create analogs of weak binding peptides. Class I binding peptides exhibiting binding affinities of 500-5000 nM, and carrying an acceptable but suboptimal primary anchor residue at one or both positions can be "fixed" by substituting preferred anchor residues in accordance with the respective supertype. The analog peptides can then be tested for crossbinding activity.

Another embodiment for generating effective peptide analogs involves the substitution of residues that have an adverse impact on peptide stability or solubility in, e.g., a liquid environment. This substitution may occur at any position of the peptide epitope. For example, a cysteine (C) can be substituted out in favor of α-amino butyric acid. Due to its chemical nature, cysteine has the propensity to form disulfide bridges and sufficiently alter the peptide structurally so as to reduce binding capacity. Substituting α-amino butyric acid for C not only alleviates this problem, but actually improves binding and crossbinding capability in certain instances (see, e.g., the review by Sette et al., In: *Persistent Viral Infections*, Eds. R. Ahmed and I. Chen, John Wiley & Sons, England, 1999). Substitution of cysteine with α-amino butyric acid may occur at any residue of a peptide epitope, i.e. at either anchor or non-anchor positions.

Representative analog peptides are set forth in Table XXII. The Table indicates the length and sequence of the analog peptide as well as the motif or supermotif, if appropriate. The information in the "Fixed Nomenclature" column indicates the residues substituted at the indicated position numbers for the respective analog.

IV.G. COMPUTER SCREENING OF PROTEIN SEQUENCES FROM DISEASE-RELATED ANTIGENS FOR SUPERMOTIF- OR MOTIF-BEARING PEPTIDES

In order to identify supermotif- or motif-bearing epitopes in a target antigen, a native protein sequence, e.g., a tumor-associated antigen, or sequences from an infectious organism, or a donor tissue for transplantation, is screened using a means for computing, such as an intellectual calculation or a computer, to determine the presence of a supermotif or motif within the sequence. The information obtained from the analysis of native peptide can be used directly to evaluate the status of the native peptide or may be utilized subsequently to generate the peptide epitope.

Computer programs that allow the rapid screening of protein sequences for the occurrence of the subject supermotifs or motifs are encompassed by the present invention; as are programs that permit the generation of analog peptides. These programs are implemented to analyze any identified amino acid sequence or operate on an unknown sequence and simultaneously determine the sequence and identify motif-bearing epitopes thereof; analogs can be simultaneously determined as well. Generally, the identified sequences will be from a pathogenic organism or a tumor-associated peptide. For example, the target molecules considered herein include, without limitation, the EXP1, LSA1, SSP2, and CSP1 proteins of PF.

In cases where the sequence of multiple variants of the same target protein are available, peptides may also be selected on the basis of their conservancy. A presently preferred criterion for conservancy defines that the entire sequence of an HLA class I binding peptide or the entire 9-mer core of a class II binding peptide, be totally (i.e., 100%) conserved in at least 79% of the sequences evaluated for a specific protein. This definition of conservancy has been employed herein; although, as appreciated by those in the art, lower or higher degrees of conservancy can be employed as appropriate for a given antigenic target.

It is important that the selection criteria utilized for prediction of peptide binding are as accurate as possible, to correlate most efficiently with actual binding. Prediction of peptides that bind, for example, to HLA-A*0201, on the basis of the presence of the appropriate primary anchors, is positive at about a 30% rate (see, e.g., Ruppert, J. et al. *Cell* 74:929, 1993). However, by extensively analyzing peptide-HLA binding data disclosed herein, data in related patent applications, and data in the art, the present inventors have developed a number of allele-specific polynomial algorithms that dramatically increase the predictive value over identification on the basis of the presence of primary anchor residues alone. These algorithms take into account not only the presence or absence of primary anchors, but also consider the positive or deleterious presence of secondary anchor residues (to account for the impact of different amino acids at different positions). The algorithms are essentially based on the premise that the overall affinity (or AG) of peptide-HLA interactions can be approximated as a linear polynomial function of the type:

$$\Delta G = a_{1i} \times a_{2i} \times a_{3i} \ldots \times a_{ni}$$

where $a_{ji}$ is a coefficient that represents the effect of the presence of a given amino acid (j) at a given position (i) along the sequence of a peptide of n amino acids. An important assumption of this method is that the effects at each position are essentially independent of each other. This assumption is justified by studies that demonstrated that peptides are bound to HLA molecules and recognized by T cells in essentially an extended conformation. Derivation of specific algorithm coefficients has been described, for example, in Gulukota, K. et al., *J. Mol. Biol.* 267:1258, 1997.

Additional methods to identify preferred peptide sequences, which also make use of specific motifs, include the use of neural networks and molecular modeling programs (see, e.g., Milik et al., *Nature Biotechnology* 16:753, 1998; Altuvia et al., *Hum. Immunol.* 58:1, 1997; Altuvia et al, *J. Mol. Biol.* 249:244, 1995; Buus, S. *Curr. Opin. Immunol.* 11:209-213, 1999; Brusic, V. et al., *Bioinformatics* 14:121-130, 1998; Parker et al., *J. Immunol.* 152:163, 1993; Meister et al., *Vaccine* 13:581, 1995; Hammer et al., *J. Exp. Med.* 180:2353, 1994; Sturniolo et al., *Nature Biotechnol.* 17:555 1999).

For example, it has been shown that in sets of A*0201 motif-bearing peptides containing at least one preferred secondary anchor residue while avoiding the presence of any deleterious secondary anchor residues, 69% of the peptides will bind A*0201 with an $IC_{50}$ less than 500 nM (Ruppert, J. et al. *Cell* 74:929, 1993). These algorithms are also flexible in that cut-off scores may be adjusted to select sets of peptides with greater or lower predicted binding properties, as desired.

In utilizing computer screening to identify peptide epitopes, a protein sequence or translated sequence may be analyzed using software developed to search for motifs, for example the "FINDPATTERNS' program (Devereux, et al. *Nucl. Acids Res.* 12:387-395, 1984) or MotifSearch 1.4 software program (D. Brown, San Diego, Calif.) to identify potential peptide sequences containing appropriate HLA binding motifs. The identified peptides can be scored using customized polynomial algorithms to predict their capacity to bind specific HLA class I or class II alleles. As appreciated by one of ordinary skill in the art, a large array of computer programming software and hardware options are available in the relevant art which can be employed to implement the motifs of the invention in order to evaluate (e.g., without limitation, to identify epitopes, identify epitope concentration per peptide length, or to generate analogs) known or unknown peptide sequences.

In accordance with the procedures described above, PF peptide epitopes and analogs thereof that are able to bind HLA supertype groups or allele-specific HLA molecules have been identified (Tables VII-XX; Table XXII).

IV.H. PREPARATION OF PEPTIDE EPITOPES

Peptides in accordance with the invention can be prepared synthetically, by recombinant DNA technology or chemical synthesis, or from natural sources such as native tumors or pathogenic organisms. Peptide epitopes may be synthesized individually or as polyepitopic peptides. Although the peptide will preferably be substantially free of other naturally occurring host cell proteins and fragments thereof, in some embodiments the peptides may be synthetically conjugated to native fragments or particles.

The peptides in accordance with the invention can be a variety of lengths, and either in their neutral (uncharged) forms or in forms which are salts. The peptides in accordance with the invention are either free of modifications such as glycosylation, side chain oxidation, or phosphorylation; or they contain these modifications, subject to the condition that modifications do not destroy the biological activity of the peptides as described herein.

Desirably, the peptide epitope will be as small as possible while still maintaining substantially all of the immunologic activity of the native protein. When possible, it may be desirable to optimize HLA class I binding peptide epitopes of the invention to a length of about 8 to about 13 amino acid residues, preferably 9 to 10. HLA class II binding peptide epitopes may be optimized to a length of about 6 to about 30 amino acids in length, preferably to between about 13 and about 20 residues. Preferably, the peptide epitopes are commensurate in size with endogenously processed pathogen-derived peptides or tumor cell peptides that are bound to the relevant HLA molecules.

The identification and preparation of peptides of other lengths can also be carried out using the techniques described herein. Moreover, it is preferred to identify native peptide regions that contain a high concentration of class I and/or class II epitopes. Such a sequence is generally selected on the basis that it contains the greatest number of epitopes per amino acid length. It is to be appreciated that epitopes can be present in a frame-shifted manner, e.g. a 10 amino acid long peptide could contain two 9 amino acid long epitopes and one 10 amino acid long epitope; upon intracellular processing, each epitope can be exposed and bound by an HLA molecule upon administration of such a peptide. This larger, preferably multi-epitopic, peptide can be generated synthetically, recombinantly, or via cleavage from the native source.

The peptides of the invention can be prepared in a wide variety of ways. For the preferred relatively short size, the peptides can be synthesized in solution or on a solid support in accordance with conventional techniques. Various automatic synthesizers are commercially available and can be used in accordance with known protocols. (See, for example, Stewart & Young, SOLID PHASE PEPTIDE SYNTHESIS, 2D. ED., Pierce Chemical Co., 1984). Further, individual peptide epitopes can be joined using chemical ligation to produce larger peptides that are still within the bounds of the invention.

Alternatively, recombinant DNA technology can be employed wherein a nucleotide sequence which encodes an immunogenic peptide of interest is inserted into an expression vector, transformed or transfected into an appropriate host cell and cultivated under conditions suitable for expression. These procedures are generally known in the art, as described generally in Sambrook et al., MOLECULAR CLONING, A LABORATORY MANUAL, Cold Spring Harbor Press, Cold Spring Harbor, N.Y. (1989). Thus, recombinant polypeptides which comprise one or more peptide sequences of the invention can be used to present the appropriate T cell epitope.

The nucleotide coding sequence for peptide epitopes of the preferred lengths contemplated herein can be synthesized by chemical techniques, for example, the phosphotriester method of Matteucci, et al., *J. Am. Chem. Soc.* 103:3185 (1981). Peptide analogs can be made simply by substituting the appropriate and desired nucleic acid base(s) for those that encode the native peptide sequence; exemplary nucleic acid substitutions are those that encode an amino acid defined by the motifs/supermotifs herein. The coding sequence can then be provided with appropriate linkers and ligated into expression vectors commonly available in the art, and the vectors used to transform suitable hosts to produce the desired fusion protein. A number of such vectors and suitable host systems are now available. For expression of the fusion proteins, the coding sequence will be provided with operably linked start and stop codons, promoter and terminator regions and usually a replication system to provide an expression vector for expression in the desired cellular host. For example, promoter sequences compatible with bacterial hosts are provided in plasmids containing convenient restriction sites for insertion of the desired coding sequence. The resulting expression vectors are transformed into suitable bacterial hosts. Of course, yeast, insect or mammalian cell hosts may also be used, employing suitable vectors and control sequences.

IV.I. ASSAYS TO DETECT T-CELL RESPONSES

Once HLA binding peptides are identified, they can be tested for the ability to elicit a T-cell response. The preparation and evaluation of motif-bearing peptides are described in PCT publications WO 94/20127 and WO 94/03205. Briefly, peptides comprising epitopes from a particular antigen are synthesized and tested for their ability to bind to the appropriate HLA proteins. These assays may involve evaluating the binding of a peptide of the invention to purified HLA class I molecules in relation to the binding of a radioiodinated reference peptide. Alternatively, cells expressing empty class I molecules (i.e. lacking peptide therein) may be evaluated for peptide binding by immunofluorescent staining and flow microfluorimetry. Other assays that may be used to evaluate peptide binding include peptide-dependent class I assembly assays and/or the inhibition of CTL recognition by peptide competition. Those peptides that bind to the class I molecule, typically with an affinity of 500 nM or less, are further evaluated for their ability to serve as targets for CTLs derived from infected or immunized individuals, as well as for their capacity to induce primary in vitro or in vivo CTL responses that can give rise to CTL populations capable of reacting with selected target cells associated with a disease. Corresponding assays are used for evaluation of HLA class II binding peptides. HLA class II motif-bearing peptides that are shown to bind, typically at an affinity of 1000 nM or less, are further evaluated for the ability to stimulate HTL responses.

Conventional assays utilized to detect T cell responses include proliferation assays, lymphokine secretion assays, direct cytotoxicity assays, and limiting dilution assays. For example, antigen-presenting cells that have been incubated with a peptide can be assayed for the ability to induce CTL responses in responder cell populations. Antigen-presenting cells can be normal cells such as peripheral blood mononuclear cells or dendritic cells. Alternatively, mutant non-human mammalian cell lines that are deficient in their ability to load class I molecules with internally processed peptides and that have been transfected with the appropriate human class I gene, may be used to test for the capacity of the peptide to induce in vitro primary CTL responses.

Peripheral blood mononuclear cells (PBMCs) may be used as the responder cell source of CTL precursors. The appropriate antigen-presenting cells are incubated with peptide, after which the peptide-loaded antigen-presenting cells are then incubated with the responder cell population under optimized culture conditions. Positive CTL activation can be determined by assaying the culture for the presence of CTLs that kill radio-labeled target cells, both specific peptide-pulsed targets as well as target cells expressing endogenously processed forms of the antigen from which the peptide sequence was derived.

More recently, a method has been devised which allows direct quantification of antigen-specific CTLs by staining with Fluorescein-labelled HLA tetrameric complexes (Altman, J. D. et al., *Proc. Natl. Acad. Sci. USA* 90:10330, 1993; Altman, J. D. et al., *Science* 274:94, 1996). Other relatively recent technical developments include staining for intracellular lymphokines, and interferon release assays or ELISPOT assays. Tetramer staining, intracellular lymphokine staining and ELISPOT assays all appear to be at least 10-fold more sensitive than more conventional assays (Lalvani, A. et al., *J. Exp. Med.* 186:859, 1997; Dunbar, P. R. et al., *Curr. Biol.* 8:413, 1998; Murali-Krishna, K. et al., *Immunity* 8:177, 1998).

HTL activation may also be assessed using such techniques known to those in the art such as T cell proliferation and secretion of lymphokines, e.g. IL-2 (see, e.g. Alexander et al., Immunity 1:751-761, 1994).

Alternatively, immunization of HLA transgenic mice can be used to determine immunogenicity of peptide epitopes. Several transgenic mouse models including mice with human A2.1, A11 (which can additionally be used to analyze HLA-A3 epitopes), and B7 alleles have been characterized and others (e.g., transgenic mice for HLA-A1 and A24) are being developed. HLA-DR1 and HLA-DR3 mouse models have also been developed. Additional transgenic mouse models with other HLA alleles may be generated as necessary. Mice may be immunized with peptides emulsified in Incomplete Freund's Adjuvant and the resulting T cells tested for their capacity to recognize peptide-pulsed target cells and target cells transfected with appropriate genes. CTL responses may be analyzed using cytotoxicity assays described above. Similarly, HTL responses may be analyzed using such assays as T cell proliferation or secretion of lymphokines Exemplary immunogenic peptide epitopes are set out in Table XXIII.

IV.J. USE OF PEPTIDE EPITOPES AS DIAGNOSTIC AGENTS AND FOR EVALUATING IMMUNE RESPONSES

HLA class I and class II binding peptides as described herein can be used, in one embodiment of the invention, as reagents to evaluate an immune response. The immune response to be evaluated may be induced by using as an immunogen any agent that may result in the production of antigen-specific CTLs or HTLs that recognize and bind to the peptide epitope(s) to be employed as the reagent. The peptide reagent need not be used as the immunogen. Assay systems that may be used for such an analysis include relatively recent technical developments such as tetramers, staining for intracellular lymphokines and interferon release assays, or ELISPOT assays.

For example, a peptide of the invention may be used in a tetramer staining assay to assess peripheral blood mononuclear cells for the presence of antigen-specific CTLs following exposure to a pathogen or immunogen. The HLA-tetrameric complex is used to directly visualize antigen-specific CTLs (see, e.g., Ogg et al., *Science* 279:2103-2106, 1998; and Altman et al., *Science* 174:94-96, 1996) and determine the frequency of the antigen-specific CTL population in a sample of peripheral blood mononuclear cells. A tetramer reagent using a peptide of the invention may be generated as follows: A peptide that binds to an HLA molecule is refolded in the presence of the corresponding HLA heavy chain and $\beta_2$-microglobulin to generate a trimolecular complex. The complex is biotinylated at the carboxyl terminal end of the heavy chain at a site that was previously engineered into the protein. Tetramer formation is then induced by the addition of streptavidin. By means of fluorescently labeled streptavidin, the tetramer can be used to stain antigen-specific cells. The cells may then be identified, for example, by flow cytometry. Such an analysis may be used for diagnostic or prognostic purposes.

Peptides of the invention may also be used as reagents to evaluate immune recall responses. (see, e.g., Bertoni et al., *J. Clin. Invest.* 100:503-513, 1997 and Penna et al., *J. Exp. Med.* 174:1565-1570, 1991.) For example, patient PBMC samples from individuals infected with PF may be analyzed for the presence of antigen-specific CTLs or HTLs using specific peptides. A blood sample containing mononuclear cells may be evaluated by cultivating the PBMCs and stimulating the cells with a peptide of the invention. After an appropriate cultivation period, the expanded cell population may be analyzed, for example, for CTL or for HTL activity.

The peptides may also be used as reagents to evaluate the efficacy of a vaccine. PBMCs obtained from a patient vaccinated with an immunogen may be analyzed using, for example, either of the methods described above. The patient is HLA typed, and peptide epitope reagents that recognize the allele-specific molecules present in that patient are selected for the analysis. The immunogenicity of the vaccine is indicated by the presence of PF epitope-specific CTLs and/or HTLs in the PBMC sample.

The peptides of the invention may also be used to make antibodies, using techniques well known in the art (see, e.g. *CURRENT PROTOCOLS IN IMMUNOLOGY*, Wiley/Greene, NY; and *Antibodies A Laboratory Manual Harlow*, Harlow and Lane, Cold Spring Harbor Laboratory Press, 1989), which may be useful as reagents to diagnose PF infection. Such antibodies include those that recognize a peptide in the context of an HLA molecule, i.e., antibodies that bind to a peptide-MHC complex.

IV.K. VACCINE COMPOSITIONS

Vaccines that contain an immunogenically effective amount of one or more peptides as described herein are a further embodiment of the invention. Once appropriately immunogenic epitopes have been defined, they can be sorted and delivered by various means, herein referred to as "vaccine" compositions. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287-294, 1991: Alonso et al., *Vaccine* 12:299-306, 1994; Jones et al., *Vaccine* 13:675-681, 1995), peptide compositions contained in immune stimulating complexes (ISCOMS) (see, e.g., Takahashi et al., *Nature* 344:873-875, 1990; Hu et al., *Clin Exp Immunol.* 113:235-243, 1998), multiple antigen peptide systems (MAPs) (see e.g., Tam, J. P., *Proc. Natl. Acad. Sci. U.S.A.* 85:5409-5413, 1988; Tam, J. P., *J. Immunol. Methods* 196:17-32, 1996), viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis.* 124:148, 1971; Chanda, P. K. et al., *Virology* 175:535, 1990), particles of viral or synthetic origin (e.g., Kofler, N. et al., *J. Immunol. Methods.* 192:25, 1996; Eldridge, J. H. et al., *Sem. Hematol.* 30:16, 1993; Falo, L. D., Jr. et al., *Nature Med.* 7:649, 1995), adjuvants (Warren, H. S., Vogel, F. R., and Chedid, L. A. *Annu. Rev. Immunol.* 4:369, 1986; Gupta, R. K. et al., *Vaccine* 11:293, 1993), liposomes (Reddy, R. et al., *J. Immunol.* 148:1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A., *Annu. Rev. Immunol.* 12:923, 1994 and Eldridge, J. H. et al., *Sem. Hematol.* 30:16, 1993). Toxin-targeted delivery technologies, also known as receptor mediated targeting, such as those of Avant Immunotherapeutics, Inc. (Needham, Mass.) may also be used.

Furthermore, vaccines in accordance with the invention encompass compositions of one or more of the claimed peptide(s). The peptide(s) can be individually linked to its own carrier; alternatively, the peptide(s) can exist as a homopolymer or heteropolymer of active peptide units. Such a polymer has the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition may be a naturally occurring region of an antigen or may be prepared, e.g., recombinantly or by chemical synthesis.

Furthermore, useful carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl-serine ($P_3CSS$).

As disclosed in greater detail herein, upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later infection, or at least partially resistant to developing an ongoing chronic infection, or derives at least some therapeutic benefit when the antigen was tumor-associated.

In some instances it may be desirable to combine the class I peptide vaccines of the invention with vaccines which induce or facilitate neutralizing antibody responses to the target antigen of interest, particularly to surface antigens. A preferred embodiment of such a composition comprises class I and class II epitopes in accordance with the invention. An alternative embodiment of such a composition comprises a class I and/or class II epitope in accordance with the invention, along with a PADRE™ (Epimmune, San Diego, Calif.) molecule (described, for example, in U.S. Pat. No. 5,736, 142). Furthermore, any of these embodiments can be administered as a nucleic acid mediated modality.

The vaccine compositions of the invention may also be used in combination with antiviral drugs such as interferon-$\alpha$.

For therapeutic or prophylactic immunization purposes, the peptides of the invention can also be expressed by viral or bacterial vectors. Examples of expression vectors include attenuated viral hosts, such as vaccinia or fowlpox. This approach involves the use of vaccinia virus, for example, as a vector to express nucleotide sequences that encode the peptides of the invention. Upon introduction into an acutely or chronically infected host or into a non-infected host, the recombinant vaccinia virus expresses the immunogenic peptide, and thereby elicits a host CTL and/or HTL response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456-460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Antigenic peptides are used to elicit a CTL and/or HTL response ex vivo, as well. Ex vivo administration is described, for example, in application U.S. Ser. No. 09/016,361 filed Jan. 30, 1998, now abandoned. The resulting CTL or HTL cells, can be used to treat chronic infections, or tumors in patients that do not respond to other conventional forms of therapy, or will not respond to a therapeutic vaccine peptide or nucleic acid in accordance with the invention. Ex vivo CTL or HTL responses to a particular antigen (infectious or tumor-associated antigen) are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 14 weeks), in which the precursor cells are activated and expanded into effector cells, the cells are infused back into the patient, where they will destroy (CTL) or facilitate destruction (HTL) of their specific target cell (an infected cell or a tumor cell). Transfected dendritic cells may also be used as antigen presenting cells. Alternatively, dendritic cells are transfected, e.g., with a minigene construct in accordance with the invention, in order to elicit immune responses. Minigenes will be discussed in greater detail in a following section.

Vaccine compositions may also be administered in vivo in combination with dendritic cell mobilization whereby loading of dendritic cells occurs in vivo.

DNA or RNA encoding one or more of the peptides of the invention can also be administered to a patient. This approach is described, for instance, in Wolff et. al., *Science* 247:1465 (1990) as well as U.S. Pat. Nos. 5,580,859; 5,589,466; 5,804,566; 5,739,118; 5,736,524; 5,679,647; WO 98/04720; and in more detail below. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. Exemplary epitopes that may be utilized in a vaccine to treat or prevent PF infection are set out in Tables XXXIII and XXXIV. The multiple epitopes to be incorporated in a given vaccine composition may be, but need not be, contiguous in sequence in the native antigen from which the epitopes are derived.

It is preferred that each of the following principles are balanced in order to make the selection.

1.) Epitopes are selected which, upon administration, mimic immune responses that have been observed to be correlated with PF clearance. For HLA Class I this includes 3-4 epitopes that come from at least one antigen of PF. For HLA Class II a similar rationale is employed; again 3-4 epitopes are selected from at least one PF antigen (see e.g., Rosenberg et al., *Science* 278:1447-1450).

2.) Epitopes are selected that have the requisite binding affinity established to be correlated with immunogenicity: for HLA Class I an $IC_{50}$ of 500 nM or less, or for Class II an $IC_{50}$ of 1000 nM or less.

3.) Sufficient supermotif bearing-peptides, or a sufficient array of allele-specific motif-bearing peptides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often preferred to select analogs because the patient may have developed tolerance to the native epitope. When selecting epitopes for infectious disease-related antigens it is preferable to select either native or analoged epitopes. Of particular relevance for infectious disease vaccines (but for cancer-related vaccines as well), are epitopes referred to as "nested epitopes." Nested epitopes occur where at least two epitopes overlap in a given peptide sequence. A peptide comprising "transcendent nested epitopes" is a peptide that has both HLA class I and HLA class II epitopes in it.

When providing nested epitopes, it is preferable to provide a sequence that has the greatest number of epitopes per provided sequence. Preferably, one avoids providing a peptide that is any longer than the amino terminus of the amino terminal epitope and the carboxyl terminus of the carboxyl terminal epitope in the peptide. When providing a longer peptide sequence, such as a sequence comprising nested epitopes, it is important to screen the sequence in order to insure that it does not have pathological or other deleterious biological properties.

5.) When creating a minigene, as disclosed in greater detail in the following section, an objective is to generate the smallest peptide possible that encompasses the epitopes of interest. The principles employed are similar, if not the same as those employed when selecting a peptide comprising nested epitopes. Furthermore, upon determination of the nucleic acid sequence to be provided as a minigene, the peptide encoded thereby is analyzed to determine whether any "junctional epitopes" have been created. A junctional epitope is an actual binding epitope, as predicted, e.g., by motif analysis, that only exists because two discrete peptide sequences are encoded directly next to each other. Junctional epitopes are generally to be avoided because the recipient may generate an immune response to that non-native epitope. Of particular concern is a junctional epitope that is a "dominant epitope." A dominant epitope may lead to such a zealous response that immune responses to other epitopes are diminished or suppressed.

IV.K.1. Minigene Vaccines

A growing body of experimental evidence demonstrates that a number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention. The use of multi-epitope minigenes is described below and in, e.g., application U.S. Ser. No. 09/311,784, now U.S. Pat. No. 6,534,482; Ishioka et al., *J. Immunol.* 162:3915-3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding nine dominant HLA-A*0201- and A11-restricted epitopes derived from the polymerase, envelope, and core proteins of HBV and human immunodeficiency virus (HIV), the PADRE™ universal HTL epitope, and an endoplasmic reticulum-translocating signal sequence was engineered. Immunization of HLA transgenic mice with this plasmid construct resulted in strong CTL induction responses against the nine epitopes tested, similar to those observed with a lipopeptide of known immunogenicity in humans, and significantly greater than immunization in oil-based adjuvants. Moreover, the immunogenicity of DNA-encoded epitopes in vivo correlated with the in vitro responses of specific CTL lines against target cells transfected with the DNA plasmid. Thus, these data show that the minigene served to both: 1.) generate a CTL response and 2.) that the induced CTLs recognized cells expressing the encoded epitopes. A similar approach may be used to develop minigenes encoding PF epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30-100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). HTL epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as "naked DNA," is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids can also be used in the formulation; in addition, glycolipids, fusogenic liposomes, peptides and compounds referred to collectively as protective, interactive, non-condensing compounds (PINC) can also be complexed to purified plasmid DNA to influence variables such as stability, intramuscular dispersion, or trafficking to specific organs or cell types (see, e.g., as described by WO 93/24640; Mannino & Gould-Fogerite, *BioTechniques* 6(7): 682 (1988); U.S. Pat. No. 5,279,833; WO 91/06309; and Felgner, et al., *Proc. Nat'l Acad. Sci. USA* 84:7413 (1987).

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (IP) for lipid-complexed DNA). Twenty-one days after immunization, splenocytes are harvested and restimulated for 1 week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is evaluated in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

IV.K.2. Combinations of CTL Peptides with Helper Peptides

Vaccine compositions comprising the peptides of the present invention, or analogs thereof, which have immunostimulatory activity may be modified to provide desired attributes, such as improved serum half life, or to enhance immunogenicity.

For instance, the ability of a peptide to induce CTL activity can be enhanced by linking the peptide to a sequence which contains at least one epitope that is capable of inducing a T helper cell response. The use of T helper epitopes in conjunction with CTL epitopes to enhance immunogenicity is illustrated, for example, in applications U.S. Ser. No. 08/197,484, now U.S. Pat. No. 6,419,931, and U.S. Ser. No. 08/464,234, now abandoned.

Particularly preferred CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues. Alternatively, the CTL peptide may be linked to the T helper peptide without a spacer.

The CTL peptide epitope may be linked to the T helper peptide epitope either directly or via a spacer either at the amino or carboxy terminus of the CTL peptide. The amino terminus of either the immunogenic peptide or the T helper peptide may be acylated. The HTL peptide epitopes used in the invention can be modified in the same manner as CTL peptides. For instance, they may be modified to include D-amino acids or be conjugated to other molecules such as lipids, proteins, sugars and the like.

In certain embodiments, the T helper peptide is one that is recognized by T helper cells present in the majority of the population. This can be accomplished by selecting amino acid sequences that bind to many, most, or all of the HLA class II molecules. These are known as "loosely HLA-restricted" or "promiscuous" T helper sequences. Examples of amino acid sequences that are promiscuous include sequences from antigens such as tetanus toxoid at positions 830-843 (QYIKANSKFIGITE; SEQ ID NO: 3799), *Plasmodium falciparum* CS protein at positions 378-398 (DIEKKIAKMEKASSVFNVVNS; SEQ ID NO: 3800), and *Streptococcus* 18 kD protein at positions 116 (GAVDSILGGVATYGAA; SEQ ID NO: 3801). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed to most preferrably bind most HLA-DR (human HLA class II) molecules. For instance, a pan-DR-binding epitope peptide having the formula: aKXVWANTLKAAa (SEQ ID NO: 3802), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, peptides comprising HTL epitopes can contain D-amino acids to increase their resistance to proteases and thus extend their serum half-life. Also, the epitope peptides of the invention can be conjugated to other molecules such as lipids, proteins or sugars, or any other synthetic compounds, to increase their biological activity. Specifically, the T helper peptide can be conjugated to one or more palmitic acid chains at either the amino or carboxyl termini.

In some embodiments it may be desirable to include in the pharmaceutical compositions of the invention at least one component which primes cytotoxic T cells. Lipids have been identified as agents capable of priming CTL in vivo against viral antigens. For example, palmitic acid residues can be attached to the ε- and α-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic comprises palmitic acid attached to ε- and α-amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinlyseryl-serine ($P_3$CSS) can be used to prime virus specific CTL when covalently attached to an appropriate peptide. (See, e.g., Deres, et al., *Nature* 342:561, 1989). Peptides of the invention can be coupled to $P_3$CSS, for example, and the lipopeptide administered to an individual to specifically prime a CTL response to the target antigen. Moreover, because the induction of neutralizing antibodies can also be primed with P3CSS-conjugated epitopes, two such compositions can be combined to more effectively elicit both humoral and cell-mediated responses to infection.

As noted herein, additional amino acids can be added to the termini of a peptide to provide for ease of linking peptides one to another, for coupling to a carrier support or larger peptide, for modifying the physical or chemical properties of the peptide or oligopeptide, or the like. Amino acids such as tyrosine, cysteine, lysine, glutamic or aspartic acid, or the like, can be introduced at the C- or N-terminus of the peptide or oligopeptide, particularly class I peptides. However, it is to be noted that modification at the carboxyl terminus of a CTL epitope may, in some cases, alter binding characteristics of the peptide. In addition, the peptide or oligopeptide sequences can differ from the natural sequence by being modified by terminal-$NH_2$ acylation, e.g., by alkanoyl ($C_1$-$C_{20}$) or thioglycolyl acetylation, terminal-carboxyl amidation, e.g., ammonia, methylamine, etc. In some instances these modifications may provide sites for linking to a support or other molecule.

IV.L. ADMINISTRATION OF VACCINES FOR THERAPEUTIC OR PROPHYLACTIC PURPOSES

The peptides of the present invention and pharmaceutical and vaccine compositions of the invention are useful for administration to mammals, particularly humans, to treat and/or prevent malaria. Vaccine compositions containing the peptides of the invention are administered to an individual susceptible to, or otherwise at risk for, malaria or to a patient infected with PF to elicit an immune response against PF antigens and thus enhance the patient's own immune response capabilities. In therapeutic applications, peptide and/or nucleic acid compositions are administered to a patient in an amount sufficient to elicit an effective CTL and/or HTL response to the PF antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

The vaccine compositions of the invention may also be used purely as prophylactic agents. The level of expected exposure (e.g., a traveler versus a resident of an area where malaria is endemic) determines the magnitude of response that is desired to be achieved by the vaccination. Therefore, some vaccination regimens may employ higher doses of the vaccine compositions, or more doses may be administered.

Generally the dosage for an initial prophylactic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. This is followed by boosting dosages of between about 1.0 µg to about 50,000 µg of peptide administered at defined intervals from about four weeks to six months after the initial administration of vaccine. The immunogenicity of the vaccine may be assessed by measuring the specific activity of CTL and HTL obtained from a sample of the patient's blood.

As noted above, peptides comprising CTL and/or HTL epitopes of the invention induce immune responses when presented by HLA molecules and contacted with a CTL or HTL specific for an epitope comprised by the peptide. The manner in which the peptide is contacted with the CTL or HTL is not critical to the invention. For instance, the peptide can be contacted with the CTL or HTL either in vivo or in vitro. If the contacting occurs in vivo, the peptide itself can be administered to the patient, or other vehicles, e.g., DNA vectors encoding one or more peptides, viral vectors encoding the peptide(s), liposomes and the like, can be used, as described herein.

For pharmaceutical compositions, the immunogenic peptides of the invention, or DNA encoding them, are generally administered to an individual who has not been infected with PF. The peptides or DNA encoding them can be administered individually or as fusions of one or more peptide sequences.

The pharmaceutical compositions may also be used to treat individuals already infected with PF. Patients can be treated with the immunogenic peptide epitopes separately or in conjunction with other treatments, as appropriate.

For therapeutic use, administration should generally begin at the first diagnosis of PF infection. This is followed by boosting doses until at least symptoms are substantially abated and for a period thereafter. Loading doses followed by boosting doses may be required.

The peptide or other compositions used for prophylaxis or the treatment of PF infection can be used, e.g., in persons who are not manifesting symptoms of disease but who act as a disease vector. In this context, it is generally important to provide an amount of the peptide epitope delivered by a mode of administration sufficient to effectively stimulate a cytotoxic T cell response; compositions which stimulate helper T cell responses can also be given in accordance with this embodiment of the invention.

The dosage for an initial therapeutic immunization generally occurs in a unit dosage range where the lower value is about 1, 5, 50, 500, or 1000 µg and the higher value is about 10,000; 20,000; 30,000; or 50,000 µg. Dosage values for a human typically range from about 500 µg to about 50,000 µg per 70 kilogram patient. Boosting dosages of between about 1.0 µg to about 50000 µg of peptide pursuant to a boosting regimen over weeks to months may be administered depending upon the patient's response and condition as determined by measuring the specific activity of CTL and HTL obtained from the patient's blood. The peptides and compositions of the present invention may be employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

Thus, for treatment of a chronically infected individual, a representative dose is in the range disclosed above. Initial doses followed by boosting doses at established intervals, e.g., from four weeks to six months, may be required, possibly for a prolonged period of time to effectively immunize an individual. Administration should continue until at least clinical symptoms or laboratory tests indicate that the PF infection has been eliminated or substantially abated and for a period thereafter. The dosages, routes of administration, and dose schedules are adjusted in accordance with methodologies known in the art.

The pharmaceutical compositions for therapeutic treatment are intended for parenteral, topical, oral, intrathecal, or local administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier. A variety of aqueous carriers may be used, e.g., water, buffered water, 0.8% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of the peptide composition is typically included in a pharmaceutical composition that comprises a human unit dose of an acceptable carrier, preferably an aqueous carrier, and is administered in a volume of fluid that is known by those of skill in the art to be used for administration of such compositions to humans (see, e.g., Remington's Pharmaceutical Sciences, 17$^{th}$ Edition, A. Gennaro, Editor, Mack Publishing Co., Easton, Pa., 1985).

The peptides of the invention may also be administered via liposomes, which serve to target the peptides to a particular tissue, such as lymphoid tissue, or to target selectively to infected cells, as well as to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., Ann. Rev. Biophys. Bioeng. 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant must, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant. A carrier can also be included, as desired, as with, e.g., lecithin for intranasal delivery.

IV.M. KITS

The peptide and nucleic acid compositions of this invention can be provided in kit form together with instructions for vaccine administration. Typically the kit would include desired peptide compositions in a container, preferably in unit dosage form and instructions for administration. An alternative kit would include a minigene construct with desired nucleic acids of the invention in a container, preferably in unit dosage form together with instructions for administration. Lymphokines such as IL-2 or IL-12 may also be included in the kit. Other kit components that may also be desirable include, for example, a sterile syringe, booster dosages, and other desired excipients.

The invention will be described in greater detail by way of specific examples. The following examples are offered for illustrative purposes, and are not intended to limit the invention in any manner. Those of skill in the art will readily recognize a variety of non-critical parameters that can be changed or modified to yield alternative embodiments in accordance with the invention.

V. EXAMPLES

The following examples illustrate identification, selection, and use of immunogenic Class I and Class II peptide epitopes for inclusion in vaccine compositions.

Example 1

HLA Class I and Class II Binding Assays

The following example of peptide binding to HLA molecules demonstrates quantification of binding affinities of HLA class I and class II peptides. Binding assays can be performed with peptides that are either motif-bearing or not motif-bearing.

Epstein-Barr virus (EBV)-transformed homozygous cell lines, fibroblasts, CIR, or 721.22 transfectants were used as sources of HLA class I molecules. These cells were maintained in vitro by culture in RPMI 1640 medium supplemented with 2 mM L-glutamine (GIBCO, Grand Island, N.Y.), 50 µM 2-ME, 100 µg/ml of streptomycin, 100 U/ml of penicillin (Irvine Scientific) and 10% heat-inactivated FCS (Irvine Scientific, Santa Ana, Calif.). Cells were grown in 225-cm² tissue culture flasks or, for large-scale cultures, in roller bottle apparatuses. The specific cell lines routinely used for purification of MHC class I and class II molecules are listed in Table XXIV.

Cell lysates were prepared and HLA molecules purified in accordance with disclosed protocols (Sidney et al., *Current Protocols in Immunology* 18.3.1 (1998); Sidney, et al., *J. Immunol.* 154:247 (1995); Sette, et al., *Mol. Immunol.* 31:813 (1994)). Briefly, cells were lysed at a concentration of $10^8$ cells/ml in 50 mM Tris-HCl, pH 8.5, containing 1% Nonidet P-40 (Fluka Biochemika, Buchs, Switzerland), 150 mM NaCl, 5 mM EDTA, and 2 mM PMSF. Lysates were cleared of debris and nuclei by centrifugation at 15,000×g for 30 min.

HLA molecules were purified from lysates by affinity chromatography. Lysates prepared as above were passed twice through two pre-columns of inactivated Sepharose CL4-B and protein A-Sepharose. Next, the lysate was passed over a column of Sepharose CL-4B beads coupled to an appropriate antibody. The antibodies used for the extraction of HLA from cell lysates are listed in Table XXV. The anti-HLA column was then washed with 10-column volumes of 10 mM Tris-HCL, pH 8.0, in 1% NP-40, PBS, 2-column volumes of PBS, and 2-column volumes of PBS containing 0.4% n-octylglucoside. Finally, MHC molecules were eluted with 50 mM diethylamine in 0.15M NaCl containing 0.4% n-octylglucoside, pH 11.5. A 1/25 volume of 2.0M Tris, pH 6.8, was added to the eluate to reduce the pH to ~8.0. Eluates were then be concentrated by centrifugation in Centriprep 30 concentrators at 2000 rpm (Amicon, Beverly, Mass.). Protein content was evaluated by a BCA protein assay (Pierce Chemical Co., Rockford, Ill.) and confirmed by SDS-PAGE.

A detailed description of the protocol utilized to measure the binding of peptides to Class I and Class II MHC has been published (Sette et al., *Mol. Immunol.* 31:813, 1994; Sidney et al., in *Current Protocols in Immunology*, Margulies, Ed., John Wiley & Sons, New York, Section 18.3, 1998). Briefly, purified MHC molecules (5 to 500 nM) were incubated with various unlabeled peptide inhibitors and 1-10 nM $^{125}$I-radiolabeled probe peptides for 48 h in PBS containing 0.05% Nonidet P-40 (NP40) (or 20% w/v digitonin for H-2 IA assays) in the presence of a protease inhibitor cocktail. The final concentrations of protease inhibitors (each from CalBioChem, La Jolla, Calif.) were 1 mM PMSF, 1.3 nM 1.10 phenanthroline, 73 µM pepstatin A, 8 mM EDTA, 6 mM N-ethylmaleimide (for Class II assays), and 200 µM N alpha-p-tosyl-L-lysine chloromethyl ketone (TLCK). All assays were performed at pH 7.0 with the exception of DRB1*0301, which was performed at pH 4.5, and DRB1*1601 (DR2w21$\beta_1$) and DRB4*0101 (DRw53), which were performed at pH 5.0. pH was adjusted as described elsewhere (see Sidney et al., in *Current Protocols in Immunology*, Margulies, Ed., John Wiley & Sons, New York, Section 18.3, 1998).

Following incubation, MHC-peptide complexes were separated from free peptide by gel filtration on 7.8 mm×15 cm TSK200 columns (TosoHaas 16215, Montgomeryville, Pa.), eluted at 1.2 mls/min with PBS pH 6.5 containing 0.5% NP40 and 0.1% NaN₃. Because the large size of the radiolabeled peptide used for the DRB1*1501 (DR2w2$\beta_1$) assay makes separation of bound from unbound peaks more difficult under these conditions, all DRB1*1501 (DR2w2$\beta_1$) assays were performed using a 7.8 mm×30 cm TSK2000 column eluted at 0.6 mls/min. The eluate from the TSK columns was passed through a Beckman 170 radioisotope detector, and radioactivity was plotted and integrated using a Hewlett-Packard 3396A integrator, and the fraction of peptide bound was determined.

Radiolabeled peptides were iodinated using the chloramine-T method. Representative radiolabeled probe peptides utilized in each assay, and its assay specific $IC_{50}$ nM, are summarized in Tables IV and V. Typically, in preliminary experiments, each MHC preparation was titered in the presence of fixed amounts of radiolabeled peptides to determine the concentration of HLA molecules necessary to bind 10-20% of the total radioactivity. All subsequent inhibition and direct binding assays were performed using these HLA concentrations.

Since under these conditions [label]<[HLA] and IC50≥[HLA], the measured $IC_{50}$ values are reasonable approximations of the true $K_D$ values. Peptide inhibitors are typically tested at concentrations ranging from 120 µg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation has proven to be the most accurate and consistent for comparing peptides that have been tested on different days, or with different lots of purified MHC.

Because the antibody used for HLA-DR purification (LB3.1) is α-chain specific, $\beta_1$ molecules are not separated from $\beta_3$ (and/or $\beta_4$ and $\beta_5$) molecules. The $\beta_1$ specificity of the binding assay is obvious in the cases of DRB1*0101 (DR1), DRB1*0802 (DR8w2), and DRB1*0803 (DR8w3), where no $\beta_3$ is expressed. It has also been demonstrated for DRB1*0301 (DR3) and DRB3*0101 (DR52a), DRB1*0401 (DR4w4), DRB1*0404 (DR4w14), DRB1*0405 (DR4w15), DRB1*1101 (DR5), DRB1*1201 (DR5w12), DRB1*1302 (DR6w19) and DRB1*0701 (DR7). The problem of β chain specificity for DRB1*1501 (DR2w2$\beta_1$), DRB5*0101 (DR2w2$\beta_2$), DRB1*1601 (DR2w21$\beta_1$), DRB5*0201 (DR51Dw21), and DRB4*0101 (DRw53) assays is circumvented by the use of fibroblasts. Development and validation of assays with regard to DRβ molecule specificity have been described previously (see, e.g., Southwood et al., *J. Immunol.* 160:3363-3373, 1998).

Binding assays as outlined above may be used to analyze supermotif and/or motif-bearing epitopes as, for example, described in Example 2.

Example 2

Identification of Conserved HLA Supermotif- and Motif-Bearing CTL Candidate Epitopes Vaccine compositions of the invention may include multiple epitopes that comprise multiple HLA supermotifs or motifs to achieve broad population coverage. This example illustrates the identification of supermotif- and motif-bearing epitopes for the inclusion in such a vaccine composition. Additional experimental details that may be relevant to this example are found in Doolan, D. L. et al., *Immunity* 7:97, 1997. Calculation of population coverage was performed using the strategy described below.

Computer Searches and Algorithms for Identification of Supermotif and/or Motif-Bearing Epitopes Computer searches for epitopes bearing HLA Class I or Class II supermotifs or motifs were performed as follows. All translated PF protein sequences were analyzed using a text string search software program, e.g., MotifSearch 1.4 (D. Brown, San Diego) to identify potential peptide sequences containing appropriate HLA binding motifs; alternative programs are readily produced in accordance with information in the art in view of the motif/supermotif disclosure herein. Furthermore, such calculations can be made mentally. Identified A2-, A3-, and DR-supermotif sequences were scored using polynomial algorithms to predict their capacity to bind to specific HLA-Class I or Class II molecules. These polynomial algorithms take into account both extended and refined motifs (that is, to account for the impact of different amino acids at different positions), and are essentially based on the premise that the overall affinity (or AG) of peptide-HLA molecule interactions can be approximated as a linear polynomial function of the type:

$$\text{``}\Delta G\text{''} = a_{1i} \times a_{2i} \times a_{3i} \times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide. This assumption is justified by studies from our laboratories that demonstrated that peptides are bound to MHC and recognized by T cells in essentially an extended conformation (data omitted herein).

The method of derivation of specific algorithm coefficients has been described in Gulukota et al., *J. Mol. Biol.* 267:1258-126, 1997; (see also Sidney et al., *Human Immunol.* 45:79-93, 1996; and Southwood et al., *J. Immunol.* 160:3363-3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-Reactive Peptides

Complete protein sequences from PF antigens were aligned, then scanned, utilizing motif identification software, to identify conserved 9- and 10-mer sequences containing the HLA-A*0201-motif main anchor specificity. Following conservancy determination and algorithm analysis to take into account the influence of secondary anchors, 53 peptides containing the HLA-A*0201 of potential interest were identified and tested for their capacity to bind to purified HLA-A*0201 molecules in vitro. Fifteen peptides bound A*0201 with $IC_{50}$ values 500 nM.

Fourteen of these peptides were subsequently tested for immunogenicity as described below. Of these, 5 scored positive both in primary in vitro CTL responses and in HLA transgenic mice.

The five immunogenic peptides were then tested for the capacity to bind to additional A2-supertype molecules (A*0202, A*0203, A*0206, and A*6802). The peptide $SSP2_{14-23}$, which was immunogenic in primary human CTL cultures and contains the $SSP2_{14-22}$ epitope (rather than $SSP2_{14-22}$ itself), was included in the analysis. In addition, the peptide $Exp-1_{83}$, which was positive in the murine CTL assays and the peptide $CSP_{425}$ and $SSP2_{230}$, were also analyzed for cross-reactive binding. As shown in Table XXVI, all eight of these peptides were found to be A2-supertype cross-reactive binders with six of these binding to three or more A2 supertype alleles.

Selection of HLA-A3 Supermotif-Bearing Epitopes

The PF protein sequences scanned above were also examined for the presence of conserved peptides with the HLA-A3 supermotif primary anchors. Further analysis using the A03 and A11 algorithms (see, e.g., Gulukota et al, *J. Mol. Biol.* 267:1258-1267, 1997 and Sidney et al, *Human Immunol.* 45:79-93, 1996) identified 203 conserved 9- or 10-mer motif-containing peptide sequences that scored high in either or both algorithms. Of these candidates, twenty five peptides were identified that bound A3 and/or A11 with binding affinities of ≤500 nM. These peptides were then tested for binding cross-reactivity to the other common A3-supertype alleles (A*3101, A*3301, and A*6801). Seven of them bound at least three of the five HLA-A3-supertype molecules tested. An eighth peptide, $LSA-1_{11}$ was also considered for further study because it bound strongly to two of the A3 supertype alleles and weakly to the other two A3 supertype alleles. (Table XXVII)

In summary, eight HLA-A3 supertype cross-reactive binding peptides derived from conserved regions of PF proteins were identified.

Selection of HLA-B7 Supermotif Bearing Epitopes

When the same PF target antigen protein sequences were also analyzed for the presence of conserved 9- or 10-mer peptides with the HLA-B7-supermotif, 26 sequences were identified. Of these 26, 24 corresponding peptides were synthesized and tested for binding to HLA-B*0702, the most common B7-supertype allele (i.e., the prototype B7 supertype allele). Four of the peptides bound B*0702 with $IC_{50}$ of ≤500 nM. These four peptides were then tested for binding to other common B7-supertype molecules (B*3501, B*51, B*5301, and B*5401). As shown in Table XXVIII, one peptide was capable of to four of the five B7 supertype alleles; another was found to bind three of the five alles.

Selection of A1 and A24 Motif-Bearing Epitopes

To further increase population coverage, HLA-A1 and -A24 epitopes can also be incorporated into potential vaccine constructs.

An analysis of the protein sequence data from the PF target antigens utilized above identified 40 A1- and 81 A24-motif-containing conserved sequences. Testing for binding to the appropriate HLA molecule (i.e., A1 or A24) was performed on a subset of those peptides. Four A1-motif peptides and four A24-motif peptides, shown in Table Table XXIX, were found to have binding capacities of 500 nM or less for the appropriate allele-specific HLA molecule.

Example 3

Confirmation of Immunogenicity

Evaluation of A*0201 Immunogenicity

It has been shown that CTL induced in $A*0201/K^b$ transgenic mice exhibit specificity similar to CTL induced in the human system (see, e.g., Vitiello et al., *J. Exp. Med.* 173:1007-1015, 1991; Wentworth et al., *Eur. J. Immunol.* 26:97-101, 1996). Accordingly, these mice were used to evaluate the immunogenicity of the fourteen conserved A*0201 motif-bearing high affinity binding peptides identified in Example 2 above.

CTL induction in transgenic mice following peptide immmunization has been described (Vitiello et al., *J. Exp. Med.* 173:1007-1015, 1991; Alexander et al.; *J. Immunol.* 159:4753-4761, 1997). In these studies, mice were injected subcutaneously at the base of the tail with each peptide (50 µg/mouse) emulsified in IFA in the presence of an excess of an $IA^b$-restricted helper peptide (140 µg/mouse) (HBV core 128-140, Sette et al., *J. Immunol.* 153:5586-5592, 1994). Eleven days after injection, splenocytes were incubated in the presence of peptide-loaded syngenic LPS blasts. After six days, cultures were assayed for cytotoxic activity using peptide-pulsed targets. The data indicated that 5 of the 14 peptides were capable of inducing primary CTL responses in $A*0201/K^b$ transgenic mice. (For these studies, a peptide was considered positive if it induced CTL (L.U. $30/10^6$ cells ≥2 in at least two transgenic animals (Wentworth et al., *Eur. J. Immunol.* 26:97-101, 1996).

The fourteen peptides that bound to HLA-A*0201 with good affinity were also tested for immunogenicity with PBMCs from at least four malaria-naïve human donors. The induction of primary CTL responses in vitro with PBMCs from normal naïve humans requires a brief treatment of the antigen-presenting cells with acidic buffer and subsequent neutralization in the presence of excess $B_2$-microglobulin and exogenous peptide (Wentworth et al., supra). By ensuring that the majority of the HLA class I molecules are occupied by exogenous peptide, these steps are essential for the induction of primary CTL responses. Such responses cannot be induced using methods developed for the induction of recall CTL responses. A peptide was considered positive if yielding more than $2 LU_{30}/10^6$ cells (lytic units 20% per $10^4$ cells, where one lytic unit corresponds to the number of effector cells required to induce 30% $^{51}$Cr release from 10,000 target cells during a 6 hr assay.) or 15% peptide-specific lysis, respectively, in at least two different primary CTL cultures. The five peptides that were positive in HLA transgenic mice were also shown to induce primary CTL responses.

The HLA-A2 cross-reactive binding peptides were tested for their ability to elicit in vitro recall responses from PBMCs of six volunteers, each of whom had an HLA-A*0201 allele, immunized with irradiated sporozoites. The results demonstrated that all of the A2-binding peptides were recognized in association with HLA-A*0201.

In addition to investigating whether the peptides could be recognized as CTL epitopes, the ability of the peptides to induce specific cytokine responses was also measured. In particular, induction of interferon-γ and TNF-α were measured, both of which have been implicated in protective immunity against malaria. PBMC from irradiated sporozoite-immunized volunteers and PBMC from naturally exposed individuals were tested. The results indicate that significant peptide-induced cytokine responses were observed for all of the A2 supermotif-bearing peptides. (See Doolan et al., *Immunity* 7:97-112, 1997.)

Evaluation of A*03/A11 Immunogenicity

The immunogenicity of the eight supermotif-bearing peptides was also evaluated in recall responses using PBMC from volunteers bearing HLA-A3 supertype alleles who had previously been immunized with irradiated sporozoites. All the peptides were recognized in association with both A3 and A33. The fraction of individuals responding to each peptide varied for the supertype overall from 50% for one of the peptides to 100% for three of the peptides.

Immunogenicity was also evaluated using PBMCs of semi-immune or nonimmune individuals naturally exposed to malaria. In this population, recall CTL responses (percentage specific lysis greater than 10%) were detected for five of the eight A3-binding peptides.

Immunogenicity of A3 supermotif-bearing peptides can also be evaluated in transgenic mice that bear a human HLA-A11 allele using methodology analogous to that for immunogenicity studies using HLA-A2.1 transgenic mice.

Evaluation of B7 Immunogenicity

Immunogenicity of two B7 supermotif-bearing peptides, $SSP2_{539}$ and the HLA-B-restricted peptide $Pfs16_{77}$ was also examined in individuals who had been exposed to PF, either through immunization or natural exposure, as described for the evaluation of A2- and A3-supermotif-bearing peptides.

Both peptides were found to be capable of inducing CTL responses. The two peptides were recognized as CTL epitopes in the context of three of the five B7 supertype alleles.

Example 4

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analogued, or "fixed" to confer upon the peptide certain characteristics, e.g. greater cross-reactivity within the group of HLA molecules that comprise a supertype, and/or greater binding affinity for some or all of those HLA molecules. Examples of analog peptides that exhibit modulated binding affinity are set forth in this example.

Analoging at Primary Anchor Residues

The primary anchor residues are analogued to modulate binding activity. For example, peptide engineering strategies are implemented to further increase the cross-reactivity of the A3-supertype candidate epitopes identified above. On the basis of the data disclosed, e.g., in related and U.S. Ser. No. 09/226,775, now abandoned, the main anchors of A3-supermotif-bearing peptides are altered, for example, to introduce a preferred V, S, or M at position 2.

To analyze the cross-reactivity of the analog peptides, each engineered analog is initially tested for binding to the prototype A3 supertype alleles A3 and A11; then, if binding capacity is maintained, for additional A3-supertype cross-reactivity.

Similarly, analogs of HLA-A2 supermotif-bearing epitopes may also be generated. For example, peptides binding to A2-supertype molecules may be engineered at primary anchor residues to possess a preferred residue (L, I, V, or M) at position 2 and/or a preferred I or V as a position 9 primary anchor residue.

The analog peptides are then tested for the ability to bind the A2 supermotif prototype allele, A*0201. Those peptides that demonstrate 500 nM binding capacity are then tested for A2-supertype cross-reactivity.

Similarly to the A2- and A3-motif bearing peptides, peptide binding to B7-supertype alleles may be improved, where possible, to achieve increased cross-reactive binding. B7 supermotif-bearing peptides may, for example, be engineered to possess a preferred residue (V, I, L, or F) at the C-terminal primary anchor position, as demonstrated by Sidney et al. (*J. Immunol.* 157:3480-3490, 1996).

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of an analog of the B7 supermotif-bearing peptide Pf SSP2$_{126}$, representing a discreet single amino acid substitution at position one, is analyzed. The peptide may be substituted with an F at position 1, rather than and L. The peptide, which binds to 3 of 5 B7 supertype alles, is then analyzed for the ability to bind all five B7-supertype molecules with a good affinity.

Because so few B7-supertype cross-reactive epitopes were identified in the initial binding screen, results from previous binding evaluations may be analyzed to identify conserved (8-, 9-, 10-, or 11-mer) peptides which bind, minimally, 3/5 B7 supertype molecules with weak affinity (IC$_{50}$ of 500 nM-5 μM). This analysis identifies additional candidate peptides that can be analogued. These peptides are tested for enhanced binding affinity and B7-supertype cross-reactivity.

Engineered analogs with sufficiently improved binding capacity or cross-reactivity are tested as described in Example 2 for the ability of the peptide to induce CTL responses using PBMC from individuals who had previously been exposed to Pf antigens. Immunogenicity may also be studied in HLA-B7-transgenic mice, following for example, IFA immunization or lipopeptide immunization.

In conclusion, these data demonstrate that by the use of even single amino acid substitutions, it is possible to increase the binding affinity and/or cross-reactivity of peptide ligands for HLA supertype molecules.

Example 5

Identification of Conserved Pf-Derived Sequences with HLA-DR Binding Motifs

Peptide epitopes bearing an HLA class II supermotif or motif may also be identified as outlined below using methodology similar to that described in Examples 1-3.

Selection of HLA-DR-Supermotif-Bearing Epitopes

To identify PF-derived, HLA class II HTL epitopes, the protein sequences from the same four PF antigens used for the identification of HLA Class I supermotif/motif sequences were analyzed for the presence of sequences bearing an HLA-DR-motif or supermotif. Specifically, 15-mer sequences were selected comprising a DR-supermotif, further comprising a 9-mer core, and three-residue N- and C-terminal flanking regions (15 amino acids total). It was also required that the 9-mer core sequence be 100% conserved in at least 79% of the sequences analyzed.

The conserved, PF-derived peptides identified above were tested for their binding capacity for various common HLA-DR molecules. All peptides were initially tested for binding to the DR molecules in the primary panel: DR1, DR4w4, and DR7. Peptides binding at least 2 of these 3 DR molecules were then tested for binding to DR2w2β1, DR2w2β2, DR6w19, and DR9 molecules in secondary assays. Finally, peptides binding at least 2 of the 4 secondary panel DR molecules, and thus cumulatively at least 4 of 7 different DR molecules, were screened for binding to DR4w15, DR5w11, and DR8w2 molecules in tertiary assays. Peptides binding at least 7 of the 10 DR molecules comprising the primary, secondary, and tertiary screening assays were considered cross-reactive DR binders. The composition of these screening panels, and the phenotypic frequency of associated antigens, are shown in Table XXX.

In conclusion, 8 cross-reactive DR-binding peptides derived from 6 independent regions were identified that bind 7 or more HLA DR alleles. Five other peptides were also identified that bound between 4 and 6 DR alleles (Table XXXI).

Selection of Conserved DR3 Motif Peptides

Because HLA-DR3 is an allele that is prevalent in Caucasian, Black, and Hispanic populations, DR3 binding capacity is an important criterion in the selection of HTL epitopes. However, data generated previously indicated that DR3 only rarely cross-reacts with other DR alleles (Sidney et al., *J. Immunol.* 149:2634-2640, 1992; Geluk et al., *J. Immunol.* 152:5742-5748, 1994; Southwood et al., *J. Immunol.* 160:3363-3373, 1998). This is not entirely surprising in that the DR3 peptide-binding motif appears to be distinct from the specificity of most other DR alleles.

To efficiently identify peptides that bind DR3, target proteins were analyzed for conserved sequences carrying one of the two DR3 specific binding motifs reported by Geluk et al. (*J. Immunol.* 152:5742-5748, 1994). Peptides containing a DR3 motif were then synthesized and tested for their DR3 binding capacity. Three peptides were found to bind DR3 with an affinity of 1 μM or less (Table XXXI), and thereby qualify as HLA class II high affinity binders. On of these peptides was also identified above as a cross-reactive DR binding peptide.

DR3 binding epitopes identified in this manner that are found to induce immunological responses as in Example 6 below may then be included in vaccine compositions with DR supermotif-bearing peptide epitopes.

Example 6

Immunogenicity of PF-Derived HTL Epitopes

The immunogenicity of the HLA class II binding epitopes identified in Example 5 was evaluated in a study testing PBMC from either healthy volunteers previously immunized with an irradiated sporozoite vaccine, and thereby immune to malaria, or PBMC from naturally exposed individuals from the Irian Java (Indonesia) region where malaria is highly endemic. Vigorous responses were seen in volunteers vaccinated with whole irradiate sporozoites. All peptides were recognized in at least one immune individual, but not in either of the two individuals for which pre-immunization sample were available. All individuals recognized at least two, and up to nine different epitopes.

In the case of Irian Java population, PBMC from over 100 different individuals were screened for reactivity. Proliferation and secretion of various lymphokines has been measured. The results demonstrate that also in this semi-immune chronically exposed population, all peptides are recognized, with the percentage of individuals yielding positive responses ranging from 7% to 29% for IFN-γ, 36% to 51% for TNF-α and 12% to 2% for proliferative responses (Table XXII.

In conclusion, the immunogenicity of class II epitopes derived from conserved regions of the PF genome has been demonstrated.

Example 7

Calculation of Phenotypic Frequencies of HLA-Supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles were determined. Gene frequencies for each HLA allele were calculated from antigen or allele frequencies utilizing the binomial distribution formulae gf=1−(SQRT(1−af)) (see, e.g., Sidney et al., *Human Immunol.* 45:79-93, 1996). To obtain overall phenotypic frequencies, cumulative gene frequencies were calculated, and the cumulative antigen frequencies derived by the use of the inverse formula [af=1−$(1-Cgf)^2$].

Where frequency data was not available at the level of DNA typing, correspondence to the serologically defined antigen frequencies was assumed. To obtain total potential supertype population coverage no linkage disequilibrium was assumed, and only alleles confirmed to belong to each of the supertypes were included (minimal estimates). Estimates of total potential coverage achieved by inter-loci combinations were made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups (see Table XXI). Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%. An analogous approach can be used to estimate population coverage achieved with combinations of class II motif-bearing epitopes.

Summary of Candidate HLA Class I and Class II Epitopes

In summary, on the basis of the data presented in the above examples, candidate peptide epitopes derived from conserved regions of PF have been identified (Table XXXIII). These include eight HLA-A2 supermotif-bearing epitopes, eight HLA-A3 supermotif-bearing epitopes, and two HLA-B7 supermotif-bearing epitope, each capable of binding to multiple A2-, A3-, or B7-supertype molecules, and immunogenic in HLA transgenic mice or antigenic for human PBL. In addition four A1 motif-bearing and four A24 motif-bearing epitopes are also include candidate CTL epitopes for inclusion in a vaccine composition.

With these 26 CTL epitopes (as disclosed herein and from the art), average population coverage, (i.e., recognition of at least one PF epitope), is predicted to be, on average, greater than 95% (range of 90.6%-99.1%), in five major ethnic populations. The potential redundancy of coverage afforded by these epitopes can be estimated using the game theory Monte Carlo simulation analysis, which is known in the art (see e.g., Osborne, M. J. and Rubinstein, A. "A course in game theory" MIT Press, 1994). As shown in FIG. 1, it is estimated that 90% of the individuals in a population comprised of the Caucasian, North American Black, Japanese, Chinese, and Hispanic ethnic groups would recognize 8 or more of the candidate epitopes described herein.

A list of PF-derived HTL epitopes that would be preferred for use in the design of minigene constructs or other vaccine formulations is summarized in Table XXXIV. As shown, 13 different peptide-binding regions have been identified which bind multiple HLA-DR molecules or bind HLA-DR3.

It is estimated that each of 10 common DR molecules recognizing the DR supermotif, and DR3, are covered by a minimum of 2 epitopes. Correspondingly, the total estimated population coverage represented by this panel of epitopes is, on average, in excess of 94% in each of the 5 major ethnic populations (Table XXXV).

Example 8

Recognition of Generation of Endogenous Processed Antigens after Priming

This example determines that CTL induced by native or analogued peptide epitopes identified and selected as described in Examples 1-6 recognize endogenously synthesized, i.e., native antigens.

Effector cells isolated from transgenic mice that are immunized with peptide epitopes as in Example 3, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}Cr$ labeled Jurkat-A2.1/$K^b$ target cells in the absence or presence of peptide, and also tested on $^{51}Cr$ labeled target cells bearing the endogenously synthesized antigen, i.e. cells that are stably transfected with PF expression vectors.

The result will demonstrate that CTL lines obtained from animals primed with peptide epitope recognize endogenously synthesized PF antigen. The choice of transgenic mouse model to be used for such an analysis depends upon the epitope(s) that is being evaluated. In addition to HLA-A*0201/$K^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 9

Activity of CTL-HTL Conjugated Epitopes in Transgenic Mice

This example illustrates the induction of CTLs and HTLs in transgenic mice by use of a PF CTL/HTL peptide conjugate whereby the vaccine composition comprises peptides administered to a PF-infected patient or an individual at risk for malaria. The peptide composition can comprise multiple CTL and/or HTL epitopes. This analysis demonstrates enhanced immunogenicity that can be achieved by inclusion of one or more HTL epitopes in a vaccine composition. Such a peptide composition can comprise a lipidated HTL epitope conjugated to a preferred CTL epitope containing, for example, at least one CTL epitope selected from Tables VII-XVIII, or an analog of that epitope. The HTL epitope is, for example, selected from Table XIX or XX.

Lipopeptide preparation: Lipopeptides are prepared by coupling the appropriate fatty acid to the amino terminus of the resin bound peptide. A typical procedure is as follows: A dichloromethane solution of a four-fold excess of a preformed symmetrical anhydride of the appropriate fatty acid is added to the resin and the mixture is allowed to react for two hours. The resin is washed with dichloromethane and dried. The resin is then treated with trifluoroacetic acid in the presence of appropriate scavengers [e.g. 5% (v/v) water] for 60 minutes at 20° C. After evaporation of excess trifluoroacetic acid, the crude peptide is washed with diethyl ether, dissolved in methanol and precipitated by the addition of water. The peptide is collected by filtration and dried.

Immunization procedures: Immunization of transgenic mice is performed as described (Alexander et al., *J. Immunol.* 159:4753-4761, 1997). For example, A2/$K^b$ mice, which are transgenic for the human HLA A2.1 allele and are useful for the assessment of the immunogenicity of HLA-A*0201 motif- or HLA-A2 supermotif-bearing epitopes, are primed subcutaneously (base of the tail) with 0.1 ml of peptide conjugate formulated in saline, or DMSO/saline. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/$K^b$ chimeric gene (e.g., Vitiello et al., *J. Exp. Med.* 173:1007, 1991)

In vitro CTL activation: One week after priming, spleen cells ($30\times10^6$ cells/flask) are co-cultured at 37° C. with syngeneic, irradiated (3000 rads), peptide coated lymphoblasts ($10\times10^6$ cells/flask) in 10 ml of culture medium/T25 flask. After six days, effector cells are harvested and assayed for cytotoxic activity.

Assay for cytotoxic activity: Target cells (1.0 to $1.5\times10^6$) are incubated at 37° C. in the presence of 200 µl of $^{51}$Cr. After 60 minutes, cells are washed three times and resuspended in R10 medium. Peptide is added where required at a concentration of 1 µg/ml. For the assay, $10^4$ $^{51}$Cr-labeled target cells are added to different concentrations of effector cells (final volume of 200 µl) in U-bottom 96-well plates. After a 6 hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a 6 hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E): target (T) ratio of 50:1 (i.e., $5\times10^5$ effector cells for 10,000 targets) in the absence of peptide and 5:1 (i.e., $5\times10^4$ effector cells for 10,000 targets) in the presence of peptide, the specific lytic units would be: $[(1/50,000)-(1/500,000)]\times10^6=18$ LU.

The results are analyzed to assess the magnitude of the CTL responses of animals injected with the immunogenic CTL/HTL conjugate vaccine preparation and are compared to the magnitude of the CTL response achieved using the CTL epitope as outlined in Example 3. Analyses similar to this may be performed to evaluate the immunogenicity of peptide conjugates containing multiple CTL epitopes and/or multiple HTL epitopes. In accordance with these procedures it is found that a CTL response is induced, and concomitantly that an HTL response is induced, upon administration of such compositions.

Example 10

Selection of CTL and HTL Epitopes for Inclusion in a PF-Specific Vaccine

This example illustrates the procedure for the selection of peptide epitopes for vaccine compositions of the invention. The peptides in the composition may be in the form of a nucleic acid sequence, either single or one or more sequences (i.e., minigene) that encodes peptide(s), or may be single and/or polyepitopic peptides.

The following principles are utilized when selecting an array of epitopes for inclusion in a vaccine composition. Each of the following principles are balanced in order to make the selection.

1.) Epitopes are selected which, upon administration, mimic immune responses that have been observed to be correlated with PF clearance. For HLA Class I this includes 3-4 epitopes that come from at least one antigen of PF. In other words, it has been observed that patients who spontaneously clear PF generate an immune response to at least 3 epitopes on at least one PF antigen. For HLA Class II a similar rationale is employed; again 3-4 epitopes are selected from at least one PF antigen.

2.) Epitopes are selected that have the requisite binding affinity established to be correlated with immunogenicity: for HLA Class I an $IC_{50}$ of 500 nM or less, or for Class II an $IC_{50}$ of 1000 nM or less.

3.) Sufficient supermotif bearing peptides, or a sufficient array of allele-specific motif bearing peptides, are selected to give broad population coverage. For example, epitopes are selected to provide at least 80% population coverage. A Monte Carlo analysis, a statistical evaluation known in the art and discussed herein, can be employed to assess breadth, or redundancy, of population coverage.

4.) When selecting epitopes for PF antigens it may be preferable to select native epitopes. Therefore, of particular relevance for infectious disease vaccines, are epitopes referred to as "nested epitopes." Nested epitopes occur where at least two epitopes overlap in a given peptide sequence. A peptide comprising "transcendent nested epitopes" is a peptide that has both HLA class I and HLA class II epitopes in it.

When providing nested epitopes, a sequence that has the greatest number of epitopes per provided sequence is provided. A limitation on this principle is to avoid providing a peptide that is any longer than the amino terminus of the amino terminal epitope and the carboxyl terminus of the carboxyl terminal epitope in the peptide. When providing a longer peptide sequence, such as a sequence comprising nested epitopes, the sequence is screened in order to insure that it does not have pathological or other deleterious biological properties.

5.) When creating a minigene, as disclosed in greater detail in Example 11, an objective is to generate the smallest peptide possible that encompasses the epitopes of interest. The principles employed are similar, if not the same as those employed when selecting a peptide comprising nested epitopes. Additionally, however, upon determination of the nucleic acid sequence to be provided as a minigene, the peptide encoded thereby is analyzed to determine whether any "junctional epitopes" have been created. A junctional epitope is an actual binding epitope, as predicted, e.g., by motif analysis. Junctional epitopes are generally to be avoided because the recipient may generate an immune response to that epitope, which is not present in a native PF protein sequence. Of particular concern is a junctional epitope that is a "dominant epitope." A dominant epitope may lead to such a zealous response that immune responses to other epitopes are diminished or suppressed.

Peptide epitopes for inclusion in vaccine compositions are, for example, selected from those listed in Tables XXXIII and XXXIV. A vaccine composition comprised of selected peptides, when administered, is safe, efficacious, and elicits an immune response similar in magnitude of an immune response that clears an acute PF infection.

Example 11

Construction of Minigene Multi-Epitope DNA Plasmids

This example describes the design and construction of a minigene expression plasmid. Minigene plasmids may, of course, contain various configurations of CTL and/or HTL epitopes or epitope analogs as described herein. Expression plasmids have been constructed and evaluated as described, for example, in U.S. Ser. No. 09/311,784 filed May 13, 1999, now U.S. Pat. No. 6,534,482, and in Ishioka et al., *J. Immunol.* 162:3915-3925, 1999.

A minigene expression plasmid may include multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. Preferred epitopes are identified, for example, in Tables XXXIII and XXXIV. HLA class I supermotif or motif-bearing peptide epitopes derived from multiple PF antigens, e.g., EXP-1, SSP2, CSP and LSA-1, are selected such that multiple supermotifs/motifs are represented to ensure broad population coverage. Similarly, HLA class II epitopes are selected from multiple PF antigens to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

This example illustrates the methods to be used for construction of such a minigene-bearing expression plasmid. Other expression vectors that may be used for minigene compositions are available and known to those of skill in the art.

The minigene DNA plasmid contains a consensus Kozak sequence and a consensus murine kappa Ig-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides, for example eight oligonucleotides, averaging approximately 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For the first PCR reaction, 5 μg of each of two oligonucleotides are annealed and extended: Oligonucleotides 1+2, 3+4, 5+6, and 7+8 are combined in 100 μl reactions containing Pfu polymerase buffer (1×=10 mM KCL, 10 mM $(NH_4)_2SO_4$, 20 mM Tris-chloride, pH 8.75, 2 mM $MgSO_4$, 0.1% Triton X-100, 100 μg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product for 25 additional cycles. The full-length product is gel-purified and cloned into pCR-blunt (Invitrogen) and individual clones are screened by sequencing.

Example 12

The Plasmid Construct and the Degree to which it Induces Immunogenicity

The degree to which the plasmid construct prepared using the methodology outlined in Example 11 is able to induce immunogenicity is evaluated through in vivo injections into mice and subsequent in vitro assessment of CTL and HTL activity, which are analysed using cytotoxicity and proliferation assays, respectively, as detailed e.g., in U.S. Ser. No. 09/311,784 filed May 13, 1999, now U.S. Pat. No. 6,534,482, and Alexander et al., *Immunity* 1:751-761, 1994. To assess the capacity of the pMin minigene construct to induce CTLs in vivo, HLA-A11/$K^b$ transgenic mice, for example, are immunized intramuscularly with 100 μg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}Cr$ release assay. The results indicate the magnitude of the CTL response directed against the A3-restricted epitope, thus indicating the in vivo immunogenicity of the minigene vaccine and polyepitopic vaccine. It is, therefore, found that the minigene elicits immune responses directed toward the HLA-A3 supermotif peptide epitopes as does the polyepitopic peptide vaccine. A similar analysis is also performed using other HLA-A2 and HLA-B7 transgenic mouse models to assess CTL induction by HLA-A2 and HLA-B7 motif or supermotif epitopes.

To assess the capacity of a class II epitope encoding minigene to induce HTLs in vivo, I-$A^b$ restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant.

CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al., *Immunity* 1:751-761, 1994). the results indicate the magnitude of the HTL response, thus demonstrating the in vivo immunogenicity of the minigene.

DNA minigenes, constructed as described in Example 11, may also be evaluated as a vaccine in combination with a boosting agent using a prime boost protocol. The boosting agent may consist of recombinant protein (e.g., Barnett et al., *Aids Res. and Human Reotroviruses* 14, Supplement 3:S299-S309, 1998) or recombinant vaccinia, for example, expressing a minigene or DNA encoding the complete protein of interest (see, e.g., Hanke et al., *Vaccine* 16:439-445, 1998; Sedegah et al., *Proc. Natl. Acad. Sci USA* 95:7648-53, 1998; Hanke and McMichael, *Immunol. Letters* 66:177-181, 1999; and Robinson et al., *Nature Med.* 5:526-34, 1999).

For example, the efficacy of the DNA minigene may be evaluated in transgenic mice. In this example, A2.1/K$^b$ transgenic mice are immunized IM with 100 µg of the DNA minigene encoding the immunogenic peptides. After an incubation period (ranging from 3-9 weeks), the mice are boosted IP with 10$^7$ pfu/mouse of a recombinant vaccinia virus expressing the same sequence encoded by the DNA minigene. Control mice are immunized with 100 µg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an IFN-γ ELISA. It is found that the minigene utilized in a prime-boost mode elicits greater immune responses toward the HLA-A2 supermotif peptides than with DNA alone. Such an analysis is also performed using other HLA-A11 and HLA-B7 transgenic mouse models to assess CTL induction by HLA-A3 and HLA-B7 motif or supermotif epitopes.

Example 13

Peptide Composition for Prophylactic Uses

Vaccine compositions of the present invention are used to prevent PF infection in persons who are at risk for such infection. For example, a polyepitopic peptide epitope composition (or a nucleic acid comprising the same) containing multiple CTL and HTL epitopes such as those selected in Examples 9 and/or 10, which are also selected to target greater than 80% of the population, is administered to individuals at risk for PF infection. The composition is provided as a single lipidated polypeptide that encompasses multiple epitopes. The vaccine is administered in an aqueous carrier comprised of Freunds Incomplete Adjuvant. The dose of peptide for the initial immunization is from about 1 to about 50,000 µg, generally 100-5,000 µg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against PF infection.

Alternatively, the polyepitopic peptide composition can be administered as a nucleic acid in accordance with methodologies known in the art and disclosed herein.

Example 14

Polyepitopic Vaccine Compositions Derived from Native PF Sequences

A native PF polyprotein sequence is screened, preferably using computer algorithms defined for each class I and/or class II supermotif or motif, to identify "relatively short" regions of the polyprotein that comprise multiple epitopes and is preferably less in length than an entire native antigen. This relatively short sequence that contains multiple distinct, even overlapping, epitopes is selected and used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with frame shifted overlapping epitopes, two 9-mer epitopes and one 10-mer epitope can be present in a 10 amino acid peptide. Such a vaccine composition is administered for therapeutic or prophylactic purposes.

The vaccine composition will preferably include, for example, three CTL epitopes and at least one HTL epitope from PF. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally such an embodiment provides for the possibility of motif-bearing epitopes for an HLA makeup that is presently unknown. Furthermore, this embodiment (absent analogs) directs the immune response to multiple peptide sequences that are actually present in native PF antigens thus avoiding the need to evaluate any junctional epitopes. Lastly, the embodiment provides an economy of scale when producing nucleic acid vaccine compositions.

Related to this embodiment, computer programs can be derived in accordance with principles in the art, which identify in a target sequence, the greatest number of epitopes per sequence length.

Example 15

Polyepitopic Vaccine Compositions Directed To Multiple Diseases

The PF peptide epitopes of the present invention are used in conjunction with peptide epitopes from target antigens related to one or more other diseases, to create a vaccine composition that is useful for the prevention or treatment of PF as well as the one or more other disease(s). Examples of the other diseases include, but are not limited to, HIV, HCV, and HBV.

For example, a polyepitopic peptide composition comprising multiple CTL and HTL epitopes that target greater than 98% of the population may be created for administration to individuals at risk for both PF and HIV infection. The composition can be provided as a single polypeptide that incorporates the multiple epitopes from the various disease-associated sources, or can be administered as a composition comprising one or more discrete epitopes.

Example 16

Use of Peptides to Evaluate an Immune Response

Peptides of the invention may be used to analyze an immune response for the presence of specific CTL or HTL populations directed to PF. Such an analysis may be performed in a manner as that described by Ogg et al., Science 279:2103-2106, 1998. In the following example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, PF HLA-A*0201-specific CTL frequencies from HLA A*0201-positive individuals at different stages of infection or following immunization using an PF peptide containing an A*0201 motif. Tetrameric complexes are synthesized as described (Musey et al., N. Engl. J. Med. 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5'triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 µl of cold phosphate-buffered saline. Tricolor analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive uninfected donors. The percentage of cells stained with the tetramer is then determined by flow cytometry. The results indicate the number of cells in the PBMC sample that contain epitope-restricted CTLs, thereby readily indicating the extent of immune response to the PF epitope, and thus the stage of infection with PF, the status of exposure to PF, or exposure to a vaccine that elicits a protective or therapeutic response.

Example 17

Use of Peptide Epitopes to Evaluate Recall Responses

The peptide epitopes of the invention are used as reagents to evaluate T cell responses, such as acute or recall responses, in patients. Such an analysis may be performed on patients who have recovered from infection, who are chronically infected with PF, or who have been vaccinated with a PF vaccine.

For example, the class I restricted CTL response of persons who have been vaccinated may be analyzed. The vaccine may be any PF vaccine. PBMC are collected from vaccinated individuals and HLA typed. Appropriate peptide epitopes of the invention that are preferably highly conserved and, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50 U/ml), streptomycin (50 µg/ml), and Hepes (10 mM) containing 10% heat-inactivated human AB serum (complete RPMI) and plated using microculture formats. A synthetic peptide comprising an epitope of the invention is added at 10 µg/ml to each well and HBV core 128-140 epitope is added at 1 µg/ml to each well as a source of T cell help during the first week of stimulation.

In the microculture format, $4 \times 10^5$ PBMC are stimulated with peptide in 8 replicate cultures in 96-well round bottom plate in 100 µl/well of complete RPMI. On days 3 and 10, 100 ml of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}$Cr release, based on comparison with uninfected control subjects as previously described (Rehermann, et al., Nature Med. 2:1104, 1108, 1996; Rehermann et al., J. Clin. Invest. 97:1655-1665, 1996; and Rehermann et al. J. Clin. Invest. 98:1432-1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. J. Virol. 66:2670-2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 µM, and labeled with 100 µCi of $^{51}$Cr (Amersham Corp., Arlington Heights, Ill.) for 1 hour after which they are washed four times with HBSS.

Cytolytic activity is determined in a standard 4-h, split well $^{51}$Cr release assay using U-bottomed 96 well plates containing 3,000 targets/well. Stimulated PBMC are tested at effector/target (E/T) ratios of 20-50:1 on day 14. Percent cytotoxicity is determined from the formula: 100×[(experimental release-spontaneous release)/maximum release-spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to PF or a PF vaccine.

The class II restricted HTL responses may also be analyzed. Purified PBMC are cultured in a 96-well flat bottom plate at a density of 1.5×10$^5$ cells/well and are stimulated with 10 μg/ml synthetic peptide, whole antigen, or PHA. Cells are routinely plated in replicates of 4-6 wells for each condition. After seven days of culture, the medium is removed and replaced with fresh medium containing 10 U/ml IL-2. Two days later, 1 μCi $^3$H-thymidine is added to each well and incubation is continued for an additional 18 hours. Cellular DNA is then harvested on glass fiber mats and analyzed for $^3$H-thymidine incorporation. Antigen-specific T cell proliferation is calculated as the ratio of $^3$H-thymidine incorporation in the presence of antigen divided by the $^3$H-thymidine incorporation in the absence of antigen.

Example 18

Induction of CTL Responses Using a Prime Boost Protocol

A prime boost protocol similar in its underlying principle to that used to evaluated the efficacy of a DNA vaccine in transgenic mice, which was described in Example 12, may also be used for the administration of the vaccine to humans. Such a vaccine regimen is includes an initial administration of, for example, naked DNA followed by a boost using recombinant virus encoding the vaccine, or recombinant protein/polypeptide or a peptides mixture administered in an adjuvant.

For example, the initial immunization may be performed using an expression vector, such as that constructed in Example 11, in the form of naked DNA administered IM (or SC or ID) in the amounts of 0.5-5, typically 100 g, at multiple sites. The DNA (0.1 to 1000 mg) can also be administered using a gene gun. Following an incubation period of 3-4 weeks, a booster dose is then administered. The booster can be recombinant fowlpox virus administered at a dose of 5-10$^7$ to 5×10$^9$ pfu. Alternative recombinant virus, such as MVA, canarypox, adenovirus, and adeno-associated viruses can also be used for the booster, or the polyepitopic protein or a mixture of the peptides can be administered. For evaluation of vaccine efficacy, patient blood samples will be obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results will indicate that a magnitude of sufficient response to achieve protective immunity against Pf is generated.

Example 19

Induction of Specific CTL Response in Humans

A human clinical trial to evaluate an immunogenic composition comprising CTL and HTL epitopes of the invention is set up as an IND Phase I, dose escalation study and carried out as a randomized, double-blind, placebo-controlled trial in patients are not infected with Pf. Such a trial is designed, for example, as follows:

A total of about 27 subjects are enrolled and divided into 3 groups:

Group I: 3 subjects are injected with placebo and 6 subjects are injected with 5 μg of peptide composition;

Group II: 3 subjects are injected with placebo and 6 subjects are injected with 50 μg peptide composition;

Group III: 3 subjects are injected with placebo and 6 subjects are injected with 500 μg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

A prophylactic field trial can also be conducted to evaluate a vaccine composition of the invention. In such a trial, issues of patient compliance are also considered in the determination of vaccine efficacy.

Example 20

Administration of Vaccine Compositions Using Dendritic Cells

Vaccines comprising peptide epitopes of the invention may be administered using dendritic cells. In this example, the immunogenic peptide epitopes are used to elicit a CTL and/or HTL response ex vivo.

Ex vivo CTL or HTL responses to a particular antigen (infectious or tumor-associated antigen) are induced by incubating in tissue culture the patient's, or genetically compatible, CTL or HTL precursor cells together with a source of antigen-presenting cells (APC), such as dendritic cells, and the appropriate immunogenic peptides. After an appropriate incubation time (typically about 14 weeks), in which the precursor cells are activated and expanded into effector cells, the cells are infused back into the patient, where they will destroy (CTL) or facilitate destruction (HTL) of their specific target cells, i.e., PF-infected cells.

Example 21

Alternative Method of Identifying Motif-Bearing Peptides

Another way of identifying motif-bearing peptides is to elute them from cells bearing defined MHC molecules. For example, EBV transformed B cell lines used for tissue typing, have been extensively characterized to determine which HLA molecules they express. In certain cases these cells express only a single type of HLA molecule. These cells can then be infected with a pathogenic organism, e.g., PF, HIV, etc. or transfected with nucleic acids that express the antigen of interest. Thereafter, peptides produced by endogenous antigen processing of peptides produced consequent to infection (or as a result of transfection) will bind to HLA molecules within the cell and be transported and displayed on the cell surface.

The peptides are then eluted from the HLA molecules by exposure to mild acid conditions and their amino acid sequence determined, e.g., by mass spectral analysis (e.g., Kubo et al., *J. Immunol.* 152:3913, 1994). Because, as disclosed herein, the majority of peptides that bind a particular HLA molecule are motif-bearing, this is an alternative modality for obtaining the motif-bearing peptides correlated with the particular HLA molecule expressed on the cell.

Alternatively, cell lines that do not express any endogenous HLA molecules can be transfected with an expression construct encoding a single HLA allele. These cells may then be used as described, i.e., they may be infected with a pathogenic organism or transfected with nucleic acid encoding an antigen of interest to isolate peptides corresponding to the pathogen or antigen of interest that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than infection or transfection, such as loading with a protein antigen, can be used to provide a source of antigen to the cell.

The above examples are provided to illustrate the invention but not to limit its scope. For example, the human terminology for the Major Histocompatibility Complex, namely HLA, is used throughout this document. It is to be appreciated that these principles can be extended to other species as well. Thus, other variants of the invention will be readily apparent to one of ordinary skill in the art and are encompassed by the appended claims. All publications, patents, and patent application cited herein are hereby incorporated by reference for all purposes.

TABLE I

| | POSITION 2 (Primary Anchor) | POSITION 3 (Primary Anchor) | POSITION C Terminus (Primary Anchor) |
|---|---|---|---|
| SUPER-MOTIFS | | | |
| A1 | TI*LVMS* | | FWY |
| A2 | LIVM*ATQ* | | IV*MATL* |
| A3 | VSMA*TLI* | | RK |
| A24 | YF*WIVLMT* | | FI*YWLM* |
| B7 | P | | VILF*MWYA* |
| B27 | RHK | | FYL*WMIVA* |

TABLE I-continued

| | POSITION 2 (Primary Anchor) | POSITION 3 (Primary Anchor) | POSITION C Terminus (Primary Anchor) |
|---|---|---|---|
| B44 | E*D* | | FWYL*IMVA* |
| B58 | ATS | | FWY*LIVMA* |
| B62 | QL*IVMP* | | FWY*MIVLA* |
| MOTIFS | | | |
| A1 | TSM | | Y |
| A1 | | DE*AS* | Y |
| A2.1 | LMV*QIAT* | | V*LIMAT* |
| A3 | LMVISATF*CGD* | | KYR*HFA* |
| A11 | VTMLISAGN*CDF* | | KR*YH* |
| A24 | YFW*M* | | FLIW |
| A*3101 | MVT*ALIS* | | R*K* |
| A*3301 | MVALF*IST* | | RK |
| A*6801 | AVT*MSLI* | | RK |
| B*0702 | P | | LMF*WYAIV* |
| B*3501 | P | | LMFWY*IVA* |
| B51 | P | | LIVF*WYAM* |
| B*5301 | P | | IMFWY*ALV* |
| B*5401 | P | | ATIVL*MFWY* |

Bolded residues are preferred, italicized residues are less preferred: A peptide is considered motif-bearing if it has primary anchors at each primary anchor position for a motif or supermotif as specified in the above table.

TABLE Ia

| | POSITION 2 (Primary Anchor) | POSITION 3 (Primary Anchor) | POSITION C Terminus (Primary Anchor) |
|---|---|---|---|
| SUPER-MOTIFS | | | |
| A1 | TI*LVMS* | | FWY |
| A2 | *VQAT* | | V*LIMAT* |
| A3 | VSMA*TLI* | | RK |
| A24 | YF*WIVLMT* | | FI*YWLM* |
| B7 | P | | VILF*MWYA* |
| B27 | RHK | | FYL*WMIVA* |
| B58 | ATS | | FWY*LIVMA* |
| B62 | QL*IVMP* | | FWY*MIVLA* |
| MOTIFS | | | |
| A1 | TSM | | Y |
| A1 | | DE*AS* | Y |
| A2.1 | *VQAT*\* | | V*LIMAT* |
| A3.2 | LMVISATF*CGD* | | KYR*HFA* |
| A11 | VTMLISAGN*CDF* | | KR*HY* |
| A24 | YFW | | FLIW |

*If 2 is V, or Q, the C-term is not L
Bolded residues are preferred, italicized residues are less preferred: A peptide is considered motif-bearingif it has primary anchors at each primary anchor position for a motif or supermotifas specified in the above table.

TABLE II

| | | | | POSITION | | | | | |
|---|---|---|---|---|---|---|---|---|---|
| | 1 | 2 | 3 | 4 | 5 | 6 | 7 | 8 | C-terminus |
| SUPERMOTIFS | | | | | | | | | |
| A1 | | | 1° Anchor TI*LVMS* | | | | | | 1° Anchor FWY |
| A2 | | 1° Anchor LIVM *ATQ* | | | | | | | 1° Anchor LIVMAT |
| A3 | preferred | | 1° Anchor VSMA *TLI* | YFW (4/5) | | YFW (3/5) | YFW (4/5) | P (4/5) | 1° Anchor RK |
| | deleterious | DE (3/5); P (5/5) | | DE (4/5) | | | | | |

TABLE II-continued

| | | 1 | 2 | 3 | 4 | 5 | 6 | 7 | 8 | 9 or C-terminus | C-terminus |
|---|---|---|---|---|---|---|---|---|---|---|---|
| A24 | | | 1° Anchor YF*WIV LMT* | | | | | | | | 1° Anchor FI*YWLM* |
| B7 | preferred | FWY (5/5) LIVM (3/5) | 1° Anchor P | FWY (4/5) | | | | | | FWY (3/5) | 1° Anchor VILF*MWYA* |
| | deleterious | DE (3/5); P (5/5); G (4/5); A (3/5); QN (3/5) | | | | /5) | | QN (4/5) | DE (4/5) | | |
| B27 | | | 1° Anchor RHK | | | | | | | | 1° Anchor FYL*WMIVA* |
| B44 | | | 1° Anchor E*D* | | | | | | | | 1° Anchor FWYLIMVA |
| B58 | | | 1° Anchor ATS | | | | | | | | 1° Anchor FWY*LIVMA* |
| B62 | | | 1° Anchor QL*IVMP* | | | | | | | | 1° Anchor FWY*MIVLA* |
| MOTIFS | | | | | | | | | | | |
| A1 9-mer | preferred | GFYW | 1° Anchor STM | DEA | YFW | | P | DEQN | YFW | | 1° Anchor Y |
| | deleterious | DE | | RHKLIV MP | A | G | A | | | | |
| A1 9-mer | preferred | GRHK | ASTCLIV M | 1° Anchor DE*AS* | GSTC | | ASTC | LIVM | DE | | 1° Anchor Y |
| | deleterious | A | RHKDEP YFW | | DE | PQN | RHK | PG | GP | | |

| | | 1 | 2 | 3 | 4 | 5 | 6 | 7 | 8 | 9 or C-terminus | C-terminus |
|---|---|---|---|---|---|---|---|---|---|---|---|
| A1 10-mer | preferred | YFW | 1° Anchor STM | DEAQN | A | YFWQN | | PASTC | GDE | P | 1° Anchor Y |
| | deleterious | GP | | RHKGLIV M | DE | RHK | QNA | RHKYFW | RHK | A | |
| A1 10-mer | preferred | YEW | STCLIVM | 1° Anchor DE*AS* | A | YFW | | PG | G | YFW | 1° Anchor Y |
| | deleterious | RHK | RHKDEP YFW | | | P | G | | PRHK | QN | |
| A2.1 9-mer | preferred | YFW | 1° Anchor LM*IVQ AT* | YFW | STC | YFW | | A | P | | 1° Anchor V*LIMAT* |
| | deleterious | DEP | | DERKH | | | RKH | DERKH | | | |
| A2.1 10-mer | preferred | AYFW | 1° Anchor LM*IVQ AT* | LVIM | G | | G | | FYWL VIM | | 1° Anchor V*LIMAT* |
| | deleterious | DEP | | DE | RKHA | P | | RKH | DERK H | RKH | |
| A3 | preferred | RHK | 1° Anchor LMVISA TF*CGD* | YFW | PRHKY FW | A | YFW | | P | | 1° Anchor KYR*HFA* |
| | deleterious | DEP | | DE | | | | | | | |
| A11 | preferred | A | 1° Anchor VTLMIS AGN*CDF* | YFW | YFW | A | YFW | YFW | P | | 1° Anchor K*RYH* |
| | deleterious | DEP | | | | | | A | G | | |
| A24 9-mer | preferred | YFWR HK | 1° Anchor YFW*M* | | STC | | | YFW | YFW | | 1° Anchor FLIW |
| | deleterious | DEG | | DE | G | QNP | DERHK | G | AQN | | |
| A24 10-mer | preferred | | 1° Anchor YFW*M* | | P | YFWP | | P | | | 1° Anchor FLIW |
| | deleterious | | | GDE | QN | RHK | DE | A | QN | DEA | |
| A3101 | preferred | RHK | 1° Anchor MVT*AL IS* | YFW | P | | YFW | YFW | AP | | 1° Anchor R*K* |
| | deleterious | DEP | | DE | | ADE | DE | DE | DE | | |
| A3301 | preferred | | 1° Anchor MVALF *IST* | YFW | | | | AYFW | | | 1° Anchor R*K* |
| | deleterious | GP | | DE | | | | | | | |
| A6801 | preferred | YFWSTC | 1° Anchor AVT*MS LI* | | | YFWLI VM | | YFW | P | | 1° Anchor R*K* |
| | deleterious | GP | | DEG | | RHK | | | A | | |

TABLE II-continued

| | | | | | | | | | | | |
|---|---|---|---|---|---|---|---|---|---|---|---|
| B0702 | preferred | RHKFWY | 1° Anchor P | RHK | | RHK | RHK | RHK | PA | 1° Anchor LMF*WY* |
| | deleterious | DEQNP | | DEP | DE | DE | GDE | QN | DE | *AIV* |
| B3501 | preferred | FWYLIVM | 1° Anchor P | FWY | | | FWY | | | 1° Anchor LMFWY |
| | deleterious | AGP | | | | G | G | | | *IVA* |
| B51 | preferred | LIVMFWY | 1° Anchor P | FWY | STC | FWY | | G | FWY | 1° Anchor LIVF*W* |
| | deleterious | AGPDERHKSTC | | | | DE | G | DEQN | GDE | *YAM* |
| B5301 | preferred | LIVMFWY | 1° Anchor P | FWY | STC | FWY | | LIVMFWY | FWY | 1° Anchor IMFWY |
| | deleterious | AGPQN | | | | | G | RHKQN | DE | *ALV* |
| B5401 | preferred | FWY | 1° Anchor P | FWYLIVM | | LIVM | | ALIVM | FWYAP | 1° Anchor ATIV*LM FWY* |
| | deleterious | GPQNDE | | GDESTC | | RHKDE | DE | QNDGE | DE | |

Italicized residues indicate less preferred or "tolerated" residues.
The information in Table II is specific for 9-mers unless otherwise specified.

TABLE III

| SEQ ID NO: | MOTIFS | | 1° anchor 1 | 2 | 3 | 4 | 5 | 1° anchor 6 | 7 | 8 | 9 |
|---|---|---|---|---|---|---|---|---|---|---|---|
| | DR4 | preferred | FMY*LIVW* | M | T | | I | VSTC*PALIM* | MH | | MH |
| | | deleterious | | | | W | | | R | | WDE |
| | DR1 | preferred | MF*LIVWY* | | | PAMQ | | VMAT*SPLIC* | M | | AVM |
| | | deleterious | | C | CH | FD | CWD | | GDE | D | |
| 3841 | DR7 | preferred | MF*LIVWY* | M | W | A | | IVMSAC*TPL* | M | | IV |
| 3842 | | deleterious | | | C | G | | | GRD | N | G |
| | DR | Supermotif | MF*LIVWY* | | | | | VMSTAC*PLI* | | | |

| DR3 MOTIFS | | 1° anchor 1 | 2 | 3 | 1° anchor 4 | 5 | 1° anchor 6 |
|---|---|---|---|---|---|---|---|
| motif a | preferred | LIVMFY | | | D | | |
| motif b | preferred | LIVMFAY | | | DNQEST | | KRH |

Italicized residues indicate less preferred or "tolerated" residues.

TABLE IV

HLA Class I Standard Peptide Binding Affinity.

| ALLELE | STANDARD PEPTIDE | SEQUENCE | SEQ ID NO: | STANDARD BINDING AFFINITY (nM) |
|---|---|---|---|---|
| A*0101 | 944.02 | YLEPAIAKY | 3575 | 25 |
| A*0201 | 941.01 | FLPSDYFPSV | 3576 | 5.0 |
| A*0202 | 941.01 | FLPSDYFPSV | 3577 | 4.3 |
| A*0203 | 941.01 | FLPSDYFPSV | 3578 | 10 |
| A*0205 | 941.01 | FLPSDYFPSV | 3579 | 4.3 |
| A*0206 | 941.01 | FLPSDYFPSV | 3580 | 3.7 |
| A*0207 | 941.01 | FLPSDYFPSV | 3581 | 23 |
| A*6802 | 1072.34 | YVIKVSARV | 3582 | 8.0 |
| A*0301 | 941.12 | KVFPYALINK | 3583 | 11 |
| A*1101 | 940.06 | AVDLYHFLK | 3584 | 6.0 |
| A*3101 | 941.12 | KVFPYALINK | 3585 | 18 |
| A*3301 | 1083.02 | STLPETYVVRR | 3586 | 29 |
| A*6801 | 941.12 | KVFPYALINK | 3587 | 8.0 |
| A*2402 | 979.02 | AYIDNYNKF | 3588 | 12 |
| B*0702 | 1075.23 | APRTLVYLL | 3589 | 5.5 |
| B*3501 | 1021.05 | FPFKYAAAF | 3590 | 7.2 |
| B51 | 1021.05 | FPFKYAAAF | 3591 | 5.5 |
| B*5301 | 1021.05 | FPFKYAAAF | 3592 | 9.3 |
| B*5401 | 1021.05 | FPFKYAAAF | 3593 | 10 |

TABLE V

HLA Class II Standard Peptide Binding Affinity.

| Allele | Nomenclature | Standard Peptide | SEQ ID | Sequence | Binding Affinity (nM) |
|---|---|---|---|---|---|
| DRB1*0101 | DR1 | 515.01 | 3594 | PKYVKQNTLKLAT | 5.0 |
| DRB1*0301 | DR3 | 829.02 | 3595 | YKTIAFDEEARR | 300 |
| DRB1*0401 | DR4w4 | 515.01 | 3596 | PKYVKQNTLKLAT | 45 |
| DRB1*0404 | DR4w14 | 717.01 | 3597 | YARFQSQTTLKQKT | 50 |
| DRB1*0405 | DR4w15 | 717.01 | 3598 | YARFQSQTTLKQKT | 38 |
| DRB1*0701 | DR7 | 553.01 | 3599 | QYIKANSKFIGITE | 25 |
| DRB1*0802 | DR8w2 | 553.01 | 3600 | QYIKANSKFIGITE | 49 |
| DRB1*0803 | DR8w3 | 553.01 | 3601 | QYIKANSKFIGITE | 1600 |
| DRB1*0901 | DR9 | 553.01 | 3602 | QYIKANSKFIGITE | 75 |
| DRB1*1101 | DR5w11 | 553.01 | 3603 | QYIKANSKFIGITE | 20 |
| DRB1*1201 | DR5w12 | 1200.05 | 3604 | EALIHQLKINPYVLS | 298 |
| DRB1*1302 | DR6w19 | 650.22 | 3605 | QYIKANAKFIGITE | 3.5 |
| DRB1*1501 | DR2w2β1 | 507.02 | 3606 | GRTQDENPVVHFFK NIVTPRTPPP | 9.1 |
| DRB3*0101 | DR52a | 511 | 3607 | NGQIGNDPNRDIL | 470 |
| DRB4*0101 | DRw53 | 717.01 | 3608 | YARFQSQTTLKQKT | 58 |
| DRB5*0101 | DR2w2β2 | 553.01 | 3609 | QYIKANSKFIGITE | 20 |

The "Nomenclature" column lists the allelic designations used in Tables XIX and XX.

TABLE VI

Allelle-specific HLA-supertype members

| HLA-supertype | Verified[a] | Predicted[b] |
|---|---|---|
| A1 | A*0101, A*2501, A*2601, A*2602, A*3201 | A*0102, A*2604, A*3601, A*4301, A*8001 |
| A2 | A*0201, A*0202, A*0203, A*0204, A*0205, A*0206, A*0207, A*0209, A*0214, A*6802, A*6901 | A*0208, A*0210, A*0211, A*0212, A*0213 |
| A3 | A*0301, A*1101, A*3101, A*3301, A*6801 | A*0302, A*1102, A*2603, A*3302, A*3303, A*3401, A*3402, A*6601, A*6602, A*7401 |
| A24 | A*2301, A*2402, A*3001 | A*2403, A*2404, A*3002, A*3003 |
| B7 | B*0702, B*0703, B*0704, B*0705, B*1508, B*3501, B*3502, B*3503, B*3503, B*3504, B*3505, B*3506, B*3507, B*3508, B*5101, B*5102, B*5103, B*5104, B*5105, B*5301, B*5401, B*5501, B*5502, B*5601, B*5602, B*6701, B*7801 | B*1511, B*4201, B*5901 |
| B27 | B*1401, B*1402, B*1509, B*2702, B*2703, B*2704, B*2705, B*2706, B*3801, B*3901, B*3902, B*7301 | B*2701, B*2707, B*2708, B*3802, B*3903, B*3904, B*3905, B*4801, 8*4802, B*1510, B*1518, B*1503 |
| B44 | B*1801, B*1802, B*3701, B*4402, B*4403, B*4404, B*4001, B*4002, B*4006 | B*4101, B*4501, B*4701, B*4901, B*5001 |
| B58 | B*5701, B*5702, B*5801, B*5802, B*1516, B*1517 | |
| B62 | B*1501, B*1502, B*1513, B*5201 | B*1301, B*1302, B*1504, B*1505, B*1506, B*1507, B*1515, B*1520, B*1521, B*1512, B*1514, B*1510 |

[a]Verified alleles include alleles whose specificity has been determined by pool sequencing analysis, peptide binding assays, or by analysis of the sequences of CTL epitopes.
[b]Predicted alleles are alleles whose specificity is predicted on the basis of B and F pocket structure to overlap with the supertype specificity.

TABLE VII

Malaria A01 Super Motif Peptides With Binding Data

| Protein | Sequence | Position | No. of Amino Acids | Sequence Frequency | Conservancy (%) | A*0101 | Seq. Id. |
|---|---|---|---|---|---|---|---|
| CSP | AILSVSSF | 6 | 8 | 19 | 100 | | 1 |
| CSP | AILSVSSFLF | 6 | 10 | 19 | 100 | | 2 |
| CSP | ALFQEYQCY | 18 | 9 | 19 | 100 | | 3 |
| CSP | EMNYYGKQENW | 52 | 11 | 19 | 100 | | 4 |
| CSP | FLFVEALF | 13 | 8 | 19 | 100 | | 5 |
| CSP | FLFVEALFQEY | 13 | 11 | 19 | 100 | | 6 |
| CSP | FVFALFQEY | 15 | 9 | 19 | 100 | 3.4000 | 7 |

TABLE VII-continued

Malaria A01 Super Motif Peptides With Binding Data

| Protein | Sequence | Position | No. of Amino Acids | Sequence Frequency | Conservancy (%) | A*0101 | Seq. Id. |
|---|---|---|---|---|---|---|---|
| CSP | GLIMVLSF | 421 | 8 | 19 | 100 | | 8 |
| CSP | GLIMVLSFLF | 421 | 10 | 19 | 100 | | 9 |
| CSP | ILSVSSFLF | 7 | 9 | 19 | 100 | | 10 |
| CSP | IMVLSFLF | 423 | 8 | 19 | 100 | | 11 |
| CSP | KIQNSLSTEW | 357 | 10 | 15 | 79 | | 12 |
| CSP | KLAILSVSSF | 4 | 10 | 19 | 100 | | 13 |
| CSP | KMEKCSSVF | 405 | 9 | 19 | 100 | | 14 |
| CSP | LIMVLSFLF | 422 | 9 | 19 | 100 | | 15 |
| CSP | LSVSSFLF | 8 | 8 | 19 | 100 | | 16 |
| CSP | NLYNELEMNY | 46 | 10 | 19 | 100 | | 17 |
| CSP | NLYNELEMNYY | 46 | 11 | 19 | 100 | | 18 |
| CSP | NIRVLNELNY | 31 | 10 | 19 | 100 | 0.0096 | 19 |
| CSP | PSDKHIEQY | 346 | 9 | 15 | 79 | | 20 |
| CSP | RVLNELNY | 33 | 8 | 19 | 100 | | 21 |
| CSP | SIGLIMVLSF | 419 | 10 | 19 | 100 | | 22 |
| CSP | SSFLFVEALF | 11 | 10 | 19 | 100 | | 23 |
| CSP | SSIGLIMVLSF | 418 | 11 | 19 | 100 | | 24 |
| CSP | VSSFLFVEALF | 10 | 11 | 19 | 100 | | 25 |
| EXP | EVNKRKSKY | 66 | 9 | 1 | 100 | | 26 |
| EXP | FLALFFIIF | 8 | 9 | 1 | 100 | | 27 |
| EXP | ILSVFFLALF | 3 | 10 | 1 | 100 | | 28 |
| EXP | ILSVFFLALFF | 3 | 11 | 1 | 100 | | 29 |
| EXP | KILSVFFLALF | 2 | 11 | 1 | 100 | | 30 |
| EXP | LLGGVGLVLY | 92 | 10 | 1 | 100 | | 31 |
| EXP | LSVFFLALF | 4 | 9 | 1 | 100 | | 32 |
| EXP | LSVFFLALFF | 4 | 10 | 1 | 100 | | 33 |
| EXP | LVEVNKRKSKY | 64 | 11 | 1 | 100 | | 34 |
| EXP | NTEKGRHPF | 102 | 9 | 1 | 100 | | 35 |
| EXP | SVFFLALF | 5 | 8 | 1 | 100 | | 36 |
| EXP | SYFFLALFF | 5 | 9 | 1 | 100 | | 37 |
| EXP | VLLGGVGLVLY | 91 | 11 | 1 | 100 | | 38 |
| LSA | DLDEFKPIVQY | 1781 | 11 | 1 | 100 | | 39 |
| LSA | DVLAEDLY | 1646 | 8 | 1 | 100 | | 40 |
| LSA | DVNDFQISKY | 1751 | 10 | 1 | 100 | | 41 |
| LSA | ELPSENERGY | 1662 | 10 | 1 | 100 | | 42 |
| LSA | ELPSENERGYY | 1662 | 10 | 1 | 100 | | 43 |
| LSA | EISEDITKY | 1897 | 9 | 1 | 100 | | 44 |
| LSA | ELSEDITKYF | 1897 | 10 | 1 | 100 | | 45 |
| LSA | ETVNISDVNDF | 1745 | 11 | 1 | 100 | | 46 |
| LSA | FIKSLFHIF | 1877 | 9 | 1 | 100 | | 47 |
| LSA | FILVNLLIF | 11 | 9 | 1 | 100 | | 48 |
| LSA | HILYISFY | 3 | 8 | 1 | 100 | | 49 |
| LSA | HILYISFYF | 3 | 9 | 1 | 100 | | 50 |
| LSA | HVLSHNSY | 59 | 8 | 1 | 100 | | 51 |
| LSA | IINDDDDKKKY | 127 | 11 | 1 | 100 | | 52 |
| LSA | ILVNLLIF | 12 | 8 | 1 | 100 | | 53 |
| LSA | ILYISFYF | 4 | 8 | 1 | 100 | | 54 |
| LSA | KIKKGKKY | 1834 | 8 | 1 | 100 | | 55 |
| LSA | KSLYDEHIKKY | 1854 | 11 | 1 | 100 | | 56 |
| LSA | KTKNNENNKF | 68 | 10 | 1 | 100 | | 57 |
| LSA | KTKNNENNKFF | 68 | 11 | 1 | 100 | | 58 |
| LSA | LSEDITKY | 1898 | 8 | 1 | 100 | | 59 |
| LSA | LSEDITKYF | 1898 | 9 | 1 | 100 | | 60 |
| LSA | NISDVNDF | 1748 | 8 | 1 | 100 | | 61 |
| LSA | NLGVSENIF | 103 | 9 | 1 | 100 | | 62 |
| LSA | NVKNVSQTNF | 88 | 10 | 1 | 100 | | 63 |
| LSA | PIVQYDNF | 1787 | 8 | 1 | 100 | | 64 |
| LSA | PSENERGY | 1664 | 8 | 1 | 100 | | 65 |
| LSA | PSENERGYY | 1664 | 9 | 1 | 100 | 0.0790 | 66 |
| LSA | QVNKEKEKF | 1869 | 9 | 1 | 100 | | 67 |
| LSA | SLYDEHIKKY | 1855 | 10 | 1 | 100 | | 68 |
| LSA | TVNISDVNDF | 1746 | 10 | 1 | 100 | | 69 |
| SSP2 | ALLACAGLAY | 509 | 10 | 10 | 100 | | 70 |
| SSP2 | ASCGVWDEW | 242 | 9 | 10 | 100 | | 71 |
| SSP2 | ATPYAGEPAPF | 526 | 11 | 8 | 80 | | 72 |
| SSP2 | CSGSIRRHNW | 55 | 10 | 10 | 100 | | 73 |
| SSP2 | DLDEPEQF | 546 | 8 | 10 | 100 | | 74 |
| SSP2 | EVCNDEVDLY | 41 | 10 | 8 | 80 | | 75 |
| SSP2 | EVEKTASCGVW | 237 | 11 | 10 | 100 | | 76 |
| SSP2 | FLIFFDLF | 14 | 8 | 10 | 100 | | 77 |
| SSP2 | FVVPGAATPY | 520 | 10 | 8 | 80 | | 78 |
| SSP2 | GIGQGINVAF | 189 | 10 | 10 | 100 | | 79 |
| SSP2 | GINVAFNRF | 193 | 9 | 10 | 100 | | 80 |
| SSP2 | GSIRRHNW | 57 | 8 | 10 | 100 | | 81 |
| SSP2 | IVFLIFFDLF | 12 | 10 | 10 | 100 | | 82 |

TABLE VII-continued

Malaria A01 Super Motif Peptides With Binding Data

| Protein | Sequence | Position | No. of Amino Acids | Sequence Frequency | Conservancy (%) | A*0101 | Seq. Id. |
|---|---|---|---|---|---|---|---|
| SSP2 | KTASCGVW | 240 | 8 | 10 | 100 | | 83 |
| SSP2 | KTASCGVWDEW | 240 | 11 | 10 | 100 | | 84 |
| SSP2 | LLACAGLAY | 510 | 9 | 10 | 100 | | 85 |
| SSP2 | LLACAGLAYKF | 510 | 11 | 10 | 100 | | 86 |
| SSP2 | LLSTNLPY | 121 | 8 | 9 | 90 | | 87 |
| SSP2 | LVIVFLIF | 10 | 8 | 10 | 100 | | 88 |
| SSP2 | LVIVFLIFF | 10 | 9 | 10 | 100 | | 89 |
| SSP2 | NIVDEIKY | 31 | 8 | 10 | 100 | | 90 |
| SSP2 | NLYADSAW | 213 | 8 | 10 | 100 | | 91 |
| SSP2 | NVKNVIGPF | 222 | 9 | 10 | 100 | | 92 |
| SSP2 | NVKYLVIVF | 6 | 9 | 10 | 100 | | 93 |
| SSP2 | PSDGKCNLY | 207 | 9 | 10 | 100 | 0.5400 | 94 |
| SSP2 | RLPEENEW | 554 | 8 | 10 | 100 | | 95 |
| SSP2 | SLLSTNLPY | 120 | 9 | 9 | 90 | | 96 |
| SSP2 | VIVFLIFF | 11 | 8 | 10 | 100 | | 97 |
| SSP2 | VIVFLIFFDLF | 11 | 11 | 10 | 100 | | 98 |
| SSP2 | VVPGAATPY | 521 | 9 | 8 | 80 | | 99 |
| SSP2 | YLVIVFLIF | 9 | 9 | 10 | 100 | | 100 |
| SSP2 | YLVIVFLIFF | 9 | 10 | 10 | 100 | | 101 |

TABLE VIII

Malaria A02 Super Motif Peptides With Binding Information

| Protein | Sequence | Position | No. of Amino Acids | Sequence Frequency | Conservancy (%) | A*0201 | A*0202 | A*0203 | A*0206 | A*6802 | Seq. Id |
|---|---|---|---|---|---|---|---|---|---|---|---|
| CSP | HIEQYLKKI | 350 | 9 | 15 | 79 | | | | | | 102 |
| CSP | KIQNSLST | 361 | 8 | 15 | 79 | | | | | | 103 |
| CSP | YLKKIQNSL | 358 | 9 | 15 | 79 | | | | | | 104 |
| CSP | YLKKIQNSLST | 358 | 11 | 15 | 79 | | | | | | 105 |
| CSP | NANANNAV | 335 | 8 | 16 | 84 | | | | | | 106 |
| CSP | NVDENANANNA | 331 | 11 | 16 | 84 | | | | | | 107 |
| CSP | ELNYDNAGI | 37 | 9 | 18 | 95 | | | | | | 108 |
| CSP | ELNYDNAGINL | 37 | 11 | 18 | 95 | | | | | | 109 |
| CSP | GINLYNEL | 44 | 8 | 18 | 95 | | | | | | 110 |
| CSP | GINLYNELEM | 44 | 10 | 18 | 95 | | | | | | 111 |
| CSP | NAGINLYNEL | 42 | 10 | 18 | 95 | | | | | | 112 |
| CSP | SLSTEWSPCSV | 365 | 11 | 18 | 95 | | | | | | 113 |
| CSP | AILSVSSFL | 6 | 9 | 19 | 100 | 0.0220 | | | | | 114 |
| CSP | AILSVSSFLFV | 6 | 11 | 19 | 100 | | | | | | 115 |
| CSP | DIEKKICKM | 402 | 9 | 19 | 100 | | | | | | 116 |
| CSP | GIQVRIKPGSA | 380 | 11 | 19 | 100 | | | | | | 117 |
| CSP | GLIMVLSFL | 425 | 9 | 19 | 100 | 0.0630 | | | | | 118 |
| CSP | GLIMVLSFLFL | 425 | 11 | 19 | 100 | | | | | | 119 |
| CSP | ILSVSSFL | 7 | 8 | 19 | 100 | | | | | | 120 |
| CSP | ILSVSSFLFV | 7 | 10 | 19 | 100 | 0.0300 | | | | | 121 |
| CSP | IMVLSFLFL | 427 | 9 | 19 | 100 | 0.0007 | | | | | 122 |
| CSP | IQVRIKPGSA | 381 | 10 | 19 | 100 | | | | | | 123 |
| CSP | KICKMEKCSSV | 406 | 11 | 19 | 100 | | | | | | 124 |
| CSP | KLAILSVSSFL | 4 | 11 | 19 | 100 | | | | | | 125 |
| CSP | KLRKPKHKKL | 104 | 10 | 19 | 100 | 0.0001 | | | | | 126 |
| CSP | KMEKCSSV | 409 | 8 | 19 | 100 | | | | | | 127 |
| CSP | KMEKCSSVFNV | 409 | 11 | 19 | 100 | | | | | | 128 |
| CSP | KQENWYSL | 58 | 8 | 19 | 100 | | | | | | 129 |
| CSP | LAILSVSSFL | 5 | 10 | 19 | 100 | | | | | | 130 |
| CSP | LIMVLSFL | 426 | 8 | 19 | 100 | | | | | | 131 |
| CSP | LIMVLSFLFL | 426 | 10 | 19 | 100 | 0.0019 | | | | | 132 |
| CSP | MMRKLAIL | 1 | 8 | 19 | 100 | | | | | | 133 |
| CSP | MMRKLAILSV | 1 | 10 | 19 | 100 | 0.0012 | | | | | 134 |
| CSP | MVLSFLFL | 428 | 8 | 19 | 100 | | | | | | 135 |
| CSP | NANPNANPNA | 300 | 10 | 19 | 100 | | | | | | 136 |
| CSP | NANPNVDPNA | 196 | 10 | 19 | 100 | | | | | | 137 |
| CSP | NLYNELEM | 46 | 8 | 19 | 100 | | | | | | 138 |
| CSP | NMPNDPNRNV | 323 | 10 | 19 | 100 | 0.0007 | | | | | 139 |
| CSP | NQGNGQGHNM | 315 | 10 | 19 | 100 | | | | | | 140 |
| CSP | NTRVLNEL | 31 | 8 | 19 | 100 | | | | | | 141 |
| CSP | NVDENANA | 331 | 8 | 19 | 100 | | | | | | 142 |
| CSP | NVDPNANPNA | 200 | 10 | 19 | 100 | | | | | | 143 |
| CSP | NVDPNANPNV | 128 | 10 | 19 | 100 | | | | | | 144 |
| CSP | NVVNSSIGL | 418 | 9 | 19 | 100 | | | | | | 145 |
| CSP | NVVNSSIGLI | 418 | 10 | 19 | 100 | | | | | | 146 |

TABLE VIII-continued

Malaria A02 Super Motif Peptides With Binding Information

| Protein | Sequence | Position | No. of Amino Acids | Sequence Frequency | Conservancy (%) | A*0201 | A*0202 | A*0203 | A*0206 | A*6802 | Seq. Id |
|---|---|---|---|---|---|---|---|---|---|---|---|
| CSP | NVVNSSIGLIM | 418 | 11 | 19 | 100 | | | | | | 147 |
| CSP | QVRIKPGSA | 382 | 9 | 19 | 100 | | | | | | 148 |
| CSP | RVLNELNYDNA | 33 | 11 | 19 | 100 | | | | | | 149 |
| CSP | SIGLIMVL | 423 | 8 | 19 | 100 | | | | | | 150 |
| CSP | SIGLIMVLSFL | 423 | 11 | 19 | 100 | | | | | | 151 |
| CSP | SLKKNSRSL | 64 | 9 | 19 | 100 | 0.0001 | | | | | 152 |
| CSP | STEWSPCSV | 367 | 9 | 19 | 100 | | | | | | 153 |
| CSP | STEWSPCSVT | 367 | 10 | 19 | 100 | | | | | | 154 |
| CSP | SVFNVVNSSI | 415 | 10 | 19 | 100 | 0.0005 | | | | | 155 |
| CSP | SVSSFLFV | 9 | 8 | 19 | 100 | | | | | | 156 |
| CSP | SVSSFLFVEA | 9 | 10 | 19 | 100 | | | | | | 157 |
| CSP | SVSSFLFVEAL | 9 | 11 | 19 | 100 | | | | | | 158 |
| CSP | SVTCGNGI | 374 | 8 | 19 | 100 | | | | | | 159 |
| CSP | SVTCGNGIQV | 374 | 10 | 19 | 100 | | | | | | 160 |
| CSP | VLNELNYDNA | 34 | 10 | 19 | 100 | | | | | | 161 |
| CSP | VTCGNGIQV | 375 | 9 | 19 | 100 | 0.0011 | | | | | 162 |
| CSP | VTCGNGIQVRI | 375 | 11 | 19 | 100 | | | | | | 163 |
| CSP | VVNSSIGL | 419 | 8 | 19 | 100 | | | | | | 164 |
| CSP | VVNSSIGLI | 419 | 9 | 19 | 100 | | | | | | 165 |
| CSP | VVNSSIGLIM | 419 | 10 | 19 | 100 | | | | | | 166 |
| CSP | VVNSSIGLIMV | 419 | 11 | 19 | 100 | | | | | | 167 |
| CSP | YQCYGSSSNT | 23 | 10 | 19 | 100 | | | | | | 168 |
| EXP | ATSVLAGL | 77 | 8 | 1 | 100 | | | | | | 169 |
| EXP | ATSVLAGLL | 77 | 9 | 1 | 100 | | | | | | 170 |
| EXP | DMIKKEEEL | 56 | 9 | 1 | 100 | | | | | | 171 |
| EXP | DMIKKEEELV | 56 | 10 | 1 | 100 | | | | | | 172 |
| EXP | DVHDLISDM | 49 | 9 | 1 | 100 | | | | | | 173 |
| EXP | DVHDLISDMI | 49 | 10 | 1 | 100 | | | | | | 174 |
| EXP | EQPQGDDNNL | 147 | 10 | 1 | 100 | | | | | | 175 |
| EXP | EQPQGDDNNLV | 147 | 11 | 1 | 100 | | | | | | 176 |
| EXP | EVNKRKSKYKL | 66 | 11 | 1 | 100 | | | | | | 177 |
| EXP | FIIFNKESL | 13 | 9 | 1 | 100 | | | | | | 178 |
| EXP | FIIFNKESLA | 13 | 10 | 1 | 100 | | | | | | 179 |
| EXP | FLALFFII | 8 | 8 | 1 | 100 | | | | | | 180 |
| EXP | GLLGNVST | 83 | 8 | 1 | 100 | | | | | | 181 |
| EXP | GLLGNVSTV | 83 | 9 | 1 | 100 | 0.0160 | | | | | 182 |
| EXP | GLLGNVSTVL | 83 | 10 | 1 | 100 | 0.0380 | | | | | 183 |
| EXP | GLLGNVSTVLL | 83 | 11 | 1 | 100 | | | | | | 184 |
| EXP | GVGLVLYNT | 95 | 9 | 1 | 100 | | | | | | 185 |
| EXP | IIFNKESL | 14 | 8 | 1 | 100 | | | | | | 186 |
| EXP | IIFNKESLA | 14 | 9 | 1 | 100 | | | | | | 187 |
| EXP | ILSVFFLA | 3 | 8 | 1 | 100 | | | | | | 188 |
| EXP | ILSVFFLAL | 3 | 9 | 1 | 100 | 0.0058 | | | | | 189 |
| EXP | KIGSSDPA | 111 | 8 | 1 | 100 | | | | | | 190 |
| EXP | KIGSSDPADNA | 111 | 11 | 1 | 100 | | | | | | 191 |
| EXP | KILSVFFL | 2 | 8 | 1 | 100 | | | | | | 192 |
| EXP | KILSVFFLA | 2 | 9 | 1 | 100 | 0.8500 | | | | | 193 |
| EXP | KILSVFFLAL | 2 | 10 | 1 | 100 | | | | | | 194 |
| EXP | KLATSVLA | 75 | 8 | 1 | 100 | | | | | | 195 |
| EXP | KLATSVLAGL | 75 | 10 | 1 | 100 | 0.0047 | | | | | 196 |
| EXP | KLATSVLAGLL | 75 | 11 | 1 | 100 | | | | | | 197 |
| EXP | KTNKGTGSGV | 24 | 10 | 1 | 100 | | | | | | 198 |
| EXP | LAEKTNKGT | 21 | 9 | 1 | 100 | | | | | | 199 |
| EXP | LAGLLGNV | 81 | 8 | 1 | 100 | | | | | | 200 |
| EXP | LAGLLGNVST | 81 | 10 | 1 | 100 | | | | | | 201 |
| EXP | LAGLLGNVSTV | 81 | 11 | 1 | 100 | | | | | | 202 |
| EXP | LATSVLAGL | 76 | 9 | 1 | 100 | | | | | | 203 |
| EXP | LATSVLAGLL | 76 | 10 | 1 | 100 | | | | | | 204 |
| EXP | LIDVHDLI | 47 | 8 | 1 | 100 | | | | | | 205 |
| EXP | LIDVHDLISDM | 47 | 11 | 1 | 100 | | | | | | 206 |
| EXP | LLGGVGLV | 92 | 8 | 1 | 100 | | | | | | 207 |
| EXP | LLGGVGLVL | 92 | 9 | 1 | 100 | 0.0038 | | | | | 208 |
| EXP | LLGNVSTV | 84 | 8 | 1 | 100 | | | | | | 209 |
| EXP | LLGNVSTVL | 84 | 9 | 1 | 100 | 0.0350 | | | | | 210 |
| EXP | LLGNVSTVLL | 84 | 10 | 1 | 100 | 0.0059 | | | | | 211 |
| EXP | MIKKEEEL | 57 | 8 | 1 | 100 | | | | | | 212 |
| EXP | MIKKEEELV | 57 | 9 | 1 | 100 | | | | | | 213 |
| EXP | MIKKEEELVEV | 57 | 11 | 1 | 100 | | | | | | 214 |
| EXP | NADPQVTA | 134 | 8 | 1 | 100 | | | | | | 215 |
| EXP | NADPQVTAQDV | 134 | 11 | 1 | 100 | | | | | | 216 |
| EXP | NTEKGRHPFKI | 102 | 11 | 1 | 100 | | | | | | 217 |
| EXP | NVSTVLLGGV | 87 | 10 | 1 | 100 | | | | | | 218 |
| EXP | PADNANPDA | 117 | 9 | 1 | 100 | | | | | | 219 |
| EXP | PLIDVHDL | 46 | 8 | 1 | 100 | | | | | | 220 |
| EXP | PLIDVHDLI | 46 | 9 | 1 | 100 | | | | | | 221 |

TABLE VIII-continued

Malaria A02 Super Motif Peptides With Binding Information

| Protein | Sequence | Position | No. of Amino Acids | Sequence Frequency | Conservancy (%) | A*0201 | A*0202 | A*0203 | A*0206 | A*6802 | Seq. Id |
|---|---|---|---|---|---|---|---|---|---|---|---|
| EXP | PQGDDNNL | 149 | 8 | 1 | 100 | | | | | | 222 |
| EXP | PQGDDNNLV | 149 | 9 | 1 | 100 | | | | | | 223 |
| EXP | PQVTAQDV | 137 | 8 | 1 | 100 | | | | | | 224 |
| EXP | PQVTAQDVT | 137 | 9 | 1 | 100 | | | | | | 225 |
| EXP | QVTAQDVT | 138 | 8 | 1 | 100 | | | | | | 226 |
| EXP | SLAEKTNKGT | 20 | 10 | 1 | 100 | | | | | | 227 |
| EXP | STVLLGGV | 89 | 8 | 1 | 100 | | | | | | 228 |
| EXP | STVLLGGVGL | 89 | 10 | 1 | 100 | | | | | | 229 |
| EXP | STVLLGGVGLV | 89 | 11 | 1 | 100 | | | | | | 230 |
| EXP | SVFFLALFFI | 5 | 10 | 1 | 100 | 0.0017 | | | | | 231 |
| EXP | SVFFLALFFII | 5 | 11 | 1 | 100 | | | | | | 232 |
| EXP | SVLAGLLGNV | 79 | 10 | 1 | 100 | 0.0022 | | | | | 233 |
| EXP | TVLLGGVGL | 90 | 9 | 1 | 100 | | | | | | 234 |
| EXP | TVLLGGVGLV | 90 | 10 | 1 | 100 | | | | | | 235 |
| EXP | TVLLGGVGLVL | 90 | 11 | 1 | 100 | | | | | | 236 |
| EXP | VLAGLLGNV | 80 | 9 | 1 | 100 | 0.0210 | | | | | 237 |
| EXP | VLAGLLGNVST | 80 | 11 | 1 | 100 | | | | | | 238 |
| EXP | VLLGGVGL | 91 | 8 | 1 | 100 | | | | | | 239 |
| EXP | VLLGGVGLV | 91 | 9 | 1 | 100 | 0.0290 | | | | | 240 |
| EXP | VLLGGVGLVL | 91 | 10 | 1 | 100 | 0.0290 | | | | | 241 |
| LSA | DIQNHTLET | 1738 | 9 | 1 | 100 | | | | | | 242 |
| LSA | DIQNHTLETV | 1738 | 10 | 1 | 100 | | | | | | 243 |
| LSA | DITKYFMKL | 1901 | 9 | 1 | 100 | | | | | | 244 |
| LSA | DLDEFKPI | 1781 | 8 | 1 | 100 | | | | | | 245 |
| LSA | DLDEFKPIV | 1781 | 9 | 1 | 100 | 0.0001 | | | | | 246 |
| LSA | DLEEKAAKET | 148 | 10 | 1 | 100 | | | | | | 247 |
| LSA | DLEEKAAKETL | 148 | 11 | 1 | 100 | | | | | | 248 |
| LSA | DLEQDRLA | 1388 | 8 | 1 | 100 | | | | | | 249 |
| LSA | DLEQERLA | 1609 | 8 | 1 | 100 | | | | | | 250 |
| LSA | DLEQERRA | 1575 | 8 | 1 | 100 | | | | | | 251 |
| LSA | DLEQRKADT | 1626 | 9 | 1 | 100 | | | | | | 252 |
| LSA | DLERTKASKET | 1184 | 11 | 1 | 100 | | | | | | 253 |
| LSA | DLIEKNENL | 1808 | 9 | 1 | 100 | | | | | | 254 |
| LSA | DLYGRLEI | 1651 | 8 | 1 | 100 | | | | | | 255 |
| LSA | DLYGRLEIPA | 1651 | 10 | 1 | 100 | | | | | | 256 |
| LSA | DLYGRLEIPAI | 1651 | 11 | 1 | 100 | | | | | | 257 |
| LSA | DVLAEDLYGRL | 1646 | 11 | 1 | 100 | | | | | | 258 |
| LSA | EILQIVDEL | 1890 | 9 | 1 | 100 | | | | | | 259 |
| LSA | EISAEYDDSL | 1763 | 10 | 1 | 100 | | | | | | 260 |
| LSA | EISAEYDDSLI | 1763 | 11 | 1 | 100 | | | | | | 261 |
| LSA | EISIIEKT | 1692 | 8 | 1 | 100 | | | | | | 262 |
| LSA | ELSEDITKYFM | 1897 | 11 | 1 | 100 | | | | | | 263 |
| LSA | ELTMSNVKNV | 83 | 10 | 1 | 100 | | | | | | 264 |
| LSA | EQDRLAKEKL | 1390 | 10 | 1 | 100 | | | | | | 265 |
| LSA | EQERLAKEKL | 1611 | 10 | 1 | 100 | | | | | | 266 |
| LSA | EQERLANEKL | 1526 | 10 | 1 | 100 | | | | | | 267 |
| LSA | EQERRAKEKL | 1577 | 10 | 1 | 100 | | | | | | 268 |
| LSA | EQKEDKSA | 1730 | 8 | 1 | 100 | | | | | | 269 |
| LSA | EQKEDKSADI | 1730 | 10 | 1 | 100 | | | | | | 270 |
| LSA | EQQRDLEQERL | 1605 | 11 | 1 | 100 | | | | | | 271 |
| LSA | EQQRDLEQRKA | 1622 | 11 | 1 | 100 | | | | | | 272 |
| LSA | EQQSDLEQDRL | 1384 | 11 | 1 | 100 | | | | | | 273 |
| LSA | EQQSDLEQERL | 1588 | 11 | 1 | 100 | | | | | | 274 |
| LSA | EQQSDLERT | 1180 | 9 | 1 | 100 | | | | | | 275 |
| LSA | EQQSDLERTKA | 1180 | 11 | 1 | 100 | | | | | | 276 |
| LSA | EQQSDSEQERL | 517 | 11 | 1 | 100 | | | | | | 277 |
| LSA | EQRKADTKKNL | 1628 | 11 | 1 | 100 | | | | | | 278 |
| LSA | ETLQEQQSDL | 1193 | 10 | 1 | 100 | | | | | | 279 |
| LSA | ETLQGQQSDL | 156 | 10 | 1 | 100 | | | | | | 280 |
| LSA | ETVNISDV | 1745 | 8 | 1 | 100 | | | | | | 281 |
| LSA | FIKSLFHI | 1877 | 8 | 1 | 100 | | | | | | 282 |
| LSA | FILVNLLI | 11 | 8 | 1 | 100 | | | | | | 283 |
| LSA | FILVNLLIFHI | 11 | 11 | 1 | 100 | | | | | | 284 |
| LSA | FQDEENIGI | 1794 | 9 | 1 | 100 | | | | | | 285 |
| LSA | FQISKYEDEI | 1755 | 10 | 1 | 100 | | | | | | 286 |
| LSA | GIEKSSEEL | 1822 | 9 | 1 | 100 | | | | | | 287 |
| LSA | GIYKELEDL | 1801 | 9 | 1 | 100 | | | | | | 288 |
| LSA | GIYKELEDLI | 1801 | 10 | 1 | 100 | | | | | | 289 |
| LSA | GQDENRQEDL | 140 | 10 | 1 | 100 | | | | | | 290 |
| LSA | GQQSDLEQERL | 1129 | 11 | 1 | 100 | | | | | | 291 |
| LSA | GVSENTFL | 105 | 8 | 1 | 100 | | | | | | 292 |
| LSA | HIFDGDNEI | 1883 | 9 | 1 | 100 | | | | | | 293 |
| LSA | HIFDIGENEIL | 1883 | 10 | 1 | 100 | | | | | | 294 |
| LSA | HIKKYKNDKQV | 1860 | 11 | 1 | 100 | | | | | | 295 |
| LSA | HILYISFYFI | 3 | 10 | 1 | 100 | 0.0033 | | | | | 296 |

TABLE VIII-continued

Malaria A02 Super Motif Peptides With Binding Information

| Protein | Sequence | Position | No. of Amino Acids | Sequence Frequency | Con

TABLE VIII-continued

Malaria A02 Super Motif Peptides With Binding Information

| Protein | Sequence | Position | No. of Amino Acids | Sequence Frequency | Conservancy (%) | A*0201 | A*0202 | A*0203 | A*0206 | A*6802 | Seq. Id |
|---|---|---|---|---|---|---|---|---|---|---|---|
| LSA | QQSDLEQERRA | 1572 | 11 | 1 | 100 | | | | | | 372 |
| LSA | QQSDLERT | 1181 | 8 | 1 | 100 | | | | | | 373 |
| LSA | QQSDLERTKA | 1181 | 10 | 1 | 100 | | | | | | 374 |
| LSA | QQSDSEQERL | 518 | 10 | 1 | 100 | | | | | | 375 |
| LSA | QQSDLEQERLA | 518 | 11 | 1 | 100 | | | | | | 376 |
| LSA | QTNFKSLL | 94 | 8 | 1 | 100 | | | | | | 377 |
| LSA | QTNFKSLLRNL | 94 | 11 | 1 | 100 | | | | | | 378 |
| LSA | QVNKEKEKFI | 1869 | 10 | 1 | 100 | | | | | | 379 |
| LSA | RLEIPAIEL | 1655 | 9 | 1 | 100 | | | | | | 380 |
| LSA | RQEDLEEKA | 145 | 9 | 1 | 100 | | | | | | 381 |
| LSA | RQEDLEEKAA | 145 | 10 | 1 | 100 | | | | | | 382 |
| LSA | RTKASKET | 1187 | 8 | 1 | 100 | | | | | | 383 |
| LSA | RTKASKETL | 1187 | 9 | 1 | 100 | | | | | | 384 |
| LSA | SADIQNHT | 1736 | 8 | 1 | 100 | | | | | | 385 |
| LSA | SADIQNHTL | 1736 | 9 | 1 | 100 | | | | | | 386 |
| LSA | SADIQNHTLET | 1736 | 11 | 1 | 100 | | | | | | 387 |
| LSA | SAEYDDSL | 1765 | 8 | 1 | 100 | | | | | | 388 |
| LSA | SAEYDDSLI | 1765 | 9 | 1 | 100 | | | | | | 389 |
| LSA | SIIEKTNRESI | 1694 | 11 | 1 | 100 | | | | | | 390 |
| LSA | SLLRNLGV | 99 | 8 | 1 | 100 | | | | | | 391 |
| LSA | SQTNFKSL | 93 | 8 | 1 | 100 | | | | | | 392 |
| LSA | SQTNFKSLL | 93 | 9 | 1 | 100 | | | | | | 393 |
| LSA | TLETVNISDV | 1743 | 10 | 1 | 100 | | | | | | 394 |
| LSA | TLQEQQSDL | 1194 | 9 | 1 | 100 | | | | | | 395 |
| LSA | TLQGQQSDL | 157 | 9 | 1 | 100 | | | | | | 396 |
| LSA | TMSNVKNV | 85 | 8 | 1 | 100 | | | | | | 397 |
| LSA | TMSNVKNVSQT | 85 | 11 | 1 | 100 | | | | | | 398 |
| LSA | TTNVEGRRDI | 1705 | 10 | 1 | 100 | | | | | | 399 |
| LSA | VLAEDLYGRL | 1647 | 10 | 1 | 100 | | | | | | 400 |
| LSA | VLSHNSYEKT | 60 | 10 | 1 | 100 | | | | | | 401 |
| LSA | YIPHQSSL | 1672 | 8 | 1 | 100 | | | | | | 402 |
| LSA | YISFYFIL | 6 | 8 | 1 | 100 | | | | | | 403 |
| LSA | YISFYFILV | 6 | 9 | 1 | 100 | 0.0016 | | | | | 404 |
| LSA | YISFYFILVNL | 6 | 11 | 1 | 100 | | | | | | 405 |
| SSP2 | AATPYAGEPA | 525 | 10 | 8 | 80 | | | | | | 406 |
| SSP2 | ATPYAGEPA | 526 | 9 | 8 | 80 | | | | | | 407 |
| SSP2 | EILHEGCTSEL | 267 | 11 | 8 | 80 | | | | | | 408 |
| SSP2 | EVCNDEVDL | 41 | 9 | 8 | 80 | | | | | | 409 |
| SSP2 | EVCNDEVDLYL | 41 | 11 | 8 | 80 | | | | | | 410 |
| SSP2 | EVDLYLLM | 46 | 8 | 8 | 80 | | | | | | 411 |
| SSP2 | FVVPGAATPYA | 520 | 11 | 8 | 80 | | | | | | 412 |
| SSP2 | GAATPYAGEPA | 524 | 11 | 8 | 80 | | | | | | 413 |
| SSP2 | ILHEGCTSEL | 268 | 10 | 8 | 80 | | | | | | 414 |
| SSP2 | LLSTNLPYGRT | 121 | 11 | 8 | 80 | | | | | | 415 |
| SSP2 | NLPYGRTNL | 125 | 9 | 8 | 80 | | | | | | 416 |
| SSP2 | SIRRHNWVNHA | 58 | 11 | 8 | 80 | | | | | | 417 |
| SSP2 | STNLPYGRT | 123 | 9 | 8 | 80 | | | | | | 418 |
| SSP2 | STNLPYGRTNL | 123 | 11 | 8 | 80 | | | | | | 419 |
| SSP2 | VVPGAATPYA | 521 | 10 | 8 | 80 | | | | | | 420 |
| SSP2 | WVNHAVPL | 64 | 8 | 8 | 80 | | | | | | 421 |
| SSP2 | WVNHAVPLA | 64 | 9 | 8 | 80 | 0.0008 | | | | | 422 |
| SSP2 | WVNHAVPLAM | 64 | 10 | 8 | 80 | | | | | | 423 |
| SSP2 | YAGEPAPFDET | 529 | 11 | 8 | 80 | | | | | | 424 |
| SSP2 | ALLQVRKHL | 136 | 9 | 9 | 90 | 0.0010 | | | | | 425 |
| SSP2 | DALLQVRKHL | 135 | 10 | 9 | 90 | | | | | | 426 |
| SSP2 | DASKNKEKALI | 106 | 11 | 9 | 90 | | | | | | 427 |
| SSP2 | DQPRPRGDNFA | 302 | 11 | 9 | 90 | | | | | | 428 |
| SSP2 | EIKYREEV | 35 | 8 | 9 | 90 | | | | | | 429 |
| SSP2 | IQDSLKESRKL | 168 | 11 | 9 | 90 | | | | | | 430 |
| SSP2 | IVDSKYREEV | 32 | 11 | 9 | 90 | | | | | | 431 |
| SSP2 | LLQVRKHL | 137 | 8 | 9 | 90 | | | | | | 432 |
| SSP2 | LQVRKHLNDRI | 138 | 11 | 9 | 90 | | | | | | 433 |
| SSP2 | QVRKHLNDRI | 139 | 10 | 9 | 90 | 0.0001 | | | | | 434 |
| SSP2 | SLKESRKL | 171 | 8 | 9 | 90 | | | | | | 435 |
| SSP2 | ALLACAGL | 509 | 8 | 10 | 100 | | | | | | 436 |
| SSP2 | ALLACAGLA | 509 | 9 | 10 | 100 | 0.0006 | | | | | 437 |
| SSP2 | AMKLIQQL | 72 | 8 | 10 | 100 | | | | | | 438 |
| SSP2 | AMKLIQQLNL | 72 | 10 | 10 | 100 | 0.0006 | | | | | 439 |
| SSP2 | AVCVEVEKT | 233 | 9 | 10 | 100 | | | | | | 440 |
| SSP2 | AVCVEVEKTA | 233 | 10 | 10 | 100 | | | | | | 441 |
| SSP2 | AVFGIGQGI | 186 | 9 | 10 | 100 | 0.0001 | | | | | 442 |
| SSP2 | AVFGIGQGINV | 186 | 11 | 10 | 100 | | | | | | 443 |
| SSP2 | AVPLAMKL | 68 | 8 | 10 | 100 | | | | | | 444 |
| SSP2 | AVPLAMKLI | 68 | 9 | 10 | 100 | 0.0001 | | | | | 445 |
| SSP2 | CAGLAYKFV | 513 | 9 | 10 | 100 | | | | | | 446 |

TABLE VIII-continued

Malaria A02 Super Motif Peptides With Binding Information

| Protein | Sequence | Position | No. of Amino Acids | Sequence Frequency | Conservancy (%) | A*0201 | A*0202 | A*0203 | A*0206 | A*6802 | Seq. Id |
|---|---|---|---|---|---|---|---|---|---|---|---|
| SSP2 | CAGLAYKFVV | 513 | 10 | 10 | 100 | 0.0015 | | | | | 447 |
| SSP2 | CVEVEKTA | 235 | 8 | 10 | 100 | | | | | | 448 |
| SSP2 | DASKNKEKA | 106 | 9 | 10 | 100 | | | | | | 449 |
| SSP2 | DASKNKEKAL | 106 | 10 | 10 | 100 | | | | | | 450 |
| SSP2 | DLDEPEQFRL | 546 | 10 | 10 | 100 | 0.0001 | | | | | 451 |
| SSP2 | DLFLVNGRDV | 19 | 10 | 10 | 100 | | | | | | 452 |
| SSP2 | DVQNNIVDEI | 27 | 10 | 10 | 100 | | | | | | 453 |
| SSP2 | EIIRLHSDA | 99 | 9 | 10 | 100 | | | | | | 454 |
| SSP2 | EILHEGCT | 267 | 8 | 10 | 100 | | | | | | 455 |
| SSP2 | ETLGEEDKDL | 538 | 10 | 10 | 100 | | | | | | 456 |
| SSP2 | EVEKTASCGV | 237 | 10 | 10 | 100 | | | | | | 457 |
| SSP2 | FLIFFDLFL | 14 | 9 | 10 | 100 | 1.2000 | | | | | 458 |
| SSP2 | FLIFFDLFLV | 14 | 10 | 10 | 100 | 0.8000 | | | | | 459 |
| SSP2 | FLVNGRDV | 21 | 8 | 10 | 100 | | | | | | 460 |
| SSP2 | FMKAVCVEV | 230 | 9 | 10 | 100 | 0.0290 | | | | | 461 |
| SSP2 | FVVPGAAT | 520 | 8 | 10 | 100 | | | | | | 462 |
| SSP2 | GIAGGLAL | 503 | 8 | 10 | 100 | | | | | | 463 |
| SSP2 | GIAGGLALL | 503 | 9 | 10 | 100 | 0.0022 | | | | | 464 |
| SSP2 | GIAGGLALLA | 503 | 10 | 10 | 100 | | | | | | 465 |
| SSP2 | GIGQGINV | 189 | 8 | 10 | 100 | | | | | | 466 |
| SSP2 | GIGQGINVA | 189 | 9 | 10 | 100 | | | | | | 467 |
| SSP2 | GINVAFNRFL | 193 | 10 | 10 | 100 | | | | | | 468 |
| SSP2 | GINVAFNRFLV | 193 | 11 | 10 | 100 | | | | | | 469 |
| SSP2 | GIPDSIQDSL | 163 | 10 | 10 | 100 | | | | | | 470 |
| SSP2 | GLALLACA | 507 | 8 | 10 | 100 | | | | | | 471 |
| SSP2 | GLALLACAGL | 507 | 10 | 10 | 100 | 0.0170 | | | | | 472 |
| SSP2 | GLALLACAGLA | 507 | 11 | 10 | 100 | | | | | | 473 |
| SSP2 | GLAYKFVV | 515 | 8 | 10 | 100 | | | | | | 474 |
| SSP2 | GLAYKFVVPGA | 515 | 11 | 10 | 100 | | | | | | 475 |
| SSP2 | GTRSRKREI | 260 | 9 | 10 | 100 | | | | | | 476 |
| SSP2 | GTRSRKREIL | 260 | 10 | 10 | 100 | | | | | | 477 |
| SSP2 | GVKIAVFGI | 182 | 9 | 10 | 100 | | | | | | 478 |
| SSP2 | GVWDEWSPCSV | 245 | 11 | 10 | 100 | | | | | | 479 |
| SSP2 | HAVPLAMKL | 67 | 9 | 10 | 100 | | | | | | 480 |
| SSP2 | HAVPLAMKLI | 67 | 10 | 10 | 100 | | | | | | 481 |
| SSP2 | HLGNVKYL | 3 | 8 | 10 | 100 | | | | | | 482 |
| SSP2 | HLGNVKYLV | 3 | 9 | 10 | 100 | 0.0017 | | | | | 483 |
| SSP2 | HLGNVKYLVI | 3 | 10 | 10 | 100 | | | | | | 484 |
| SSP2 | HLGNVKYLVIV | 3 | 11 | 10 | 100 | | | | | | 485 |
| SSP2 | HLNDRINRENA | 143 | 11 | 10 | 100 | | | | | | 486 |
| SSP2 | HVPNSEDRET | 445 | 10 | 10 | 100 | | | | | | 487 |
| SSP2 | IAGGIAGGL | 500 | 9 | 10 | 100 | | | | | | 488 |
| SSP2 | IAGGIAGGLA | 500 | 10 | 10 | 100 | | | | | | 489 |
| SSP2 | IAGGIAGGLAL | 500 | 11 | 10 | 100 | | | | | | 490 |
| SSP2 | IAGGLALL | 504 | 8 | 10 | 100 | | | | | | 491 |
| SSP2 | IAGGLALLA | 504 | 9 | 10 | 100 | 0.0001 | | | | | 492 |
| SSP2 | IAGGLALLACA | 504 | 11 | 10 | 100 | | | | | | 493 |
| SSP2 | IAVFGIGQGI | 185 | 10 | 10 | 100 | | | | | | 494 |
| SSP2 | IIRLHSDA | 100 | 8 | 10 | 100 | | | | | | 495 |
| SSP2 | ILTDGIPDSI | 159 | 10 | 10 | 100 | | | | | | 496 |
| SSP2 | IVFLIFFDL | 12 | 9 | 10 | 100 | 0.0024 | | | | | 497 |
| SSP2 | IVFLIFFDLFL | 12 | 11 | 10 | 100 | | | | | | 498 |
| SSP2 | KAVCVEVEKT | 232 | 10 | 10 | 100 | | | | | | 499 |
| SSP2 | KAVCVEVEKTA | 232 | 11 | 10 | 100 | | | | | | 500 |
| SSP2 | KIAGGIAGGL | 499 | 10 | 10 | 100 | | | | | | 501 |
| SSP2 | KIAGGIAGGLA | 499 | 11 | 10 | 100 | | | | | | 502 |
| SSP2 | KIAVFGIGQGI | 184 | 11 | 10 | 100 | | | | | | 503 |
| SSP2 | KLIQQLNL | 74 | 8 | 10 | 100 | | | | | | 504 |
| SSP2 | LACAGLAYKFV | 511 | 11 | 10 | 100 | | | | | | 505 |
| SSP2 | LALLACAGL | 508 | 9 | 10 | 100 | | | | | | 506 |
| SSP2 | LALLACAGLA | 508 | 10 | 10 | 100 | | | | | | 507 |
| SSP2 | LAMKLIQQL | 71 | 9 | 10 | 100 | | | | | | 508 |
| SSP2 | LAMKLIQQLNL | 71 | 11 | 10 | 100 | | | | | | 509 |
| SSP2 | LAYKFVVPGA | 516 | 10 | 10 | 100 | | | | | | 510 |
| SSP2 | LAYKFVVPGAA | 516 | 11 | 10 | 100 | | | | | | 511 |
| SSP2 | LIFFDLFL | 15 | 8 | 10 | 100 | | | | | | 512 |
| SSP2 | LIFFDLFLV | 15 | 9 | 10 | 100 | 0.0890 | | | | | 513 |
| SSP2 | LLACAGLA | 510 | 8 | 10 | 100 | | | | | | 514 |
| SSP2 | LLMDCSGSI | 51 | 9 | 10 | 100 | 0.0460 | | | | | 515 |
| SSP2 | LMDCSGSI | 52 | 8 | 10 | 100 | | | | | | 516 |
| SSP2 | LIDGIPDSI | 160 | 9 | 10 | 100 | | | | | | 517 |
| SSP2 | LVIVFLIFFDL | 10 | 11 | 10 | 100 | | | | | | 518 |
| SSP2 | LVNGRDVQNNI | 22 | 11 | 10 | 100 | | | | | | 519 |
| SSP2 | LVVILTDGI | 156 | 9 | 10 | 100 | | | | | | 520 |
| SSP2 | NANQLVVI | 152 | 8 | 10 | 100 | | | | | | 521 |

TABLE VIII-continued

Malaria A02 Super Motif Peptides With Binding Information

| Protein | Sequence | Position | No. of Amino Acids | Sequence Frequency | Conservancy (%) | A*0201 | A*0202 | A*0203 | A*0206 | A*6802 | Seq. Id |
|---|---|---|---|---|---|---|---|---|---|---|---|
| SSP2 | NANQLVVIL | 152 | 9 | 10 | 100 | | | | | | 522 |
| SSP2 | NANQLVVILT | 152 | 10 | 10 | 100 | | | | | | 523 |
| SSP2 | NIPEDSEKEV | 366 | 10 | 10 | 100 | | | | | | 524 |
| SSP2 | NLYADSAWENV | 213 | 11 | 10 | 100 | | | | | | 525 |
| SSP2 | NQLVVILT | 154 | 8 | 10 | 100 | | | | | | 526 |
| SSP2 | NQLVVILTDGI | 154 | 11 | 10 | 100 | | | | | | 527 |
| SSP2 | NVAFNRFL | 195 | 8 | 10 | 100 | | | | | | 528 |
| SSP2 | NVAFNRFLV | 195 | 9 | 10 | 100 | 0.0001 | | | | | 529 |
| SSP2 | NVIGPFMKA | 225 | 9 | 10 | 100 | 0.0002 | | | | | 530 |
| SSP2 | NVIGPFMKAV | 225 | 10 | 10 | 100 | 0.0008 | | | | | 531 |
| SSP2 | NVKNVIGPFM | 222 | 10 | 10 | 100 | | | | | | 532 |
| SSP2 | NVKYLVIV | 6 | 8 | 10 | 100 | | | | | | 533 |
| SSP2 | NVKYLVIVFL | 6 | 10 | 10 | 100 | | | | | | 534 |
| SSP2 | NVKYLVIVFLI | 6 | 11 | 10 | 100 | | | | | | 535 |
| SSP2 | PAPFDETL | 533 | 8 | 10 | 100 | | | | | | 536 |
| SSP2 | PLAMKLIQQL | 70 | 10 | 10 | 100 | | | | | | 537 |
| SSP2 | QLVVILTDGI | 155 | 10 | 10 | 100 | 0.0002 | | | | | 538 |
| SSP2 | RINRENANQL | 147 | 10 | 10 | 100 | | | | | | 539 |
| SSP2 | RINRENANQLV | 147 | 11 | 10 | 100 | | | | | | 540 |
| SSP2 | SAWENVKNV | 218 | 9 | 10 | 100 | 0.0019 | | | | | 541 |
| SSP2 | SAWENVKNVI | 218 | 10 | 10 | 100 | | | | | | 542 |
| SSP2 | SIRRHNWV | 58 | 8 | 10 | 100 | | | | | | 543 |
| SSP2 | SQDNNGNRHV | 437 | 10 | 10 | 100 | | | | | | 544 |
| SSP2 | SVTCGKGT | 254 | 8 | 10 | 100 | | | | | | 545 |
| SSP2 | TLGEEDKDL | 539 | 9 | 10 | 100 | 0.0001 | | | | | 546 |
| SSP2 | VAFNRFLV | 196 | 8 | 10 | 100 | | | | | | 547 |
| SSP2 | VIGPFMKA | 226 | 8 | 10 | 100 | | | | | | 548 |
| SSP2 | VIGPFMKAV | 226 | 9 | 10 | 100 | 0.0004 | | | | | 549 |
| SSP2 | VIGPFMKAVCV | 226 | 11 | 10 | 100 | | | | | | 550 |
| SSP2 | VILTDGIPDSI | 158 | 11 | 10 | 100 | | | | | | 551 |
| SSP2 | VIVFLIFFDL | 11 | 10 | 10 | 100 | 0.0038 | | | | | 552 |
| SSP2 | VQNNIVDEI | 28 | 9 | 10 | 100 | | | | | | 553 |
| SSP2 | VVILTDGI | 157 | 8 | 10 | 100 | | | | | | 554 |
| SSP2 | YADSAWENV | 215 | 9 | 10 | 100 | | | | | | 555 |
| SSP2 | YLLMDCSGSI | 50 | 10 | 10 | 100 | 0.1700 | | | | | 556 |
| SSP2 | YLVIVFLI | 9 | 8 | 10 | 100 | | | | | | 557 |

TABLE IX

Malaria A03 Super Motif Peptides With Binding Data

| Protein | Sequence | Position | No. of Amino Acids | Sequence Frequency | Conservancy (%) | A*0301 | A*1101 | A*3101 | A*3301 | A*6801 | Seq. Id. |
|---|---|---|---|---|---|---|---|---|---|---|---|
| CSP | DIEKKICK | 402 | 8 | 19 | 100 | | | | | | 558 |
| CSP | DIEKKICKMEK | 402 | 11 | 19 | 100 | | | | | | 559 |
| CSP | ELEMNYYGK | 50 | 9 | 19 | 100 | 0.0001 | 0.0003 | | | | 560 |
| CSP | KLRKPKHK | 104 | 8 | 19 | 100 | | | | | | 561 |
| CSP | KLRKPKHKK | 104 | 9 | 19 | 100 | 0.1300 | 0.0037 | | | | 562 |
| CSP | KLRKPKHKKLK | 104 | 11 | 19 | 100 | | | | | | 563 |
| CSP | NANANNAVK | 335 | 9 | 16 | 84 | 0.0001 | 0.0002 | 0.0006 | 0.0096 | 0.0210 | 564 |
| CSP | NANPNANPNK | 304 | 10 | 19 | 100 | 0.0005 | 0.0021 | 0.0009 | 0.0009 | 0.0054 | 565 |
| CSP | NMPNDPNR | 323 | 8 | 19 | 100 | | | | | | 566 |
| CSP | SVTCGNGIQVR | 374 | 11 | 19 | 100 | | | | | | 567 |
| CSP | VTCGNGIQVR | 375 | 10 | 19 | 100 | 0.0005 | 0.0340 | | | | 568 |
| CSP | YSLKKNSR | 63 | 8 | 19 | 100 | | | | | | 569 |
| EXP | ALFFIIFNK | 10 | 9 | 1 | 100 | 1.1000 | 1.2000 | | | | 570 |
| EXP | DLISDMIK | 52 | 8 | 1 | 100 | | | | | | 571 |
| EXP | DLISDMIKK | 52 | 9 | 1 | 100 | 0.0001 | 0.0003 | | | | 572 |
| EXP | DVHDLISDMIK | 49 | 11 | 1 | 100 | | | | | | 573 |
| EXP | ELVEVNKR | 63 | 8 | 1 | 100 | | | | | | 574 |
| EXP | ELVEVNKRK | 63 | 9 | 1 | 100 | 0.0001 | 0.0002 | | | | 575 |
| EXP | ELVEVNKRKSK | 63 | 11 | 1 | 100 | | | | | | 576 |
| EXP | ESLAEKTNK | 19 | 9 | 1 | 100 | 0.0001 | 0.0002 | 0.0004 | 0.0110 | 0.0260 | 577 |
| EXP | EVNKRKSK | 66 | 8 | 1 | 100 | | | | | | 578 |
| EXP | EVNKRKSKYK | 66 | 10 | 1 | 100 | 0.0005 | 0.0002 | | | | 579 |
| EXP | FLALFFIIFNK | 8 | 11 | 1 | 100 | | | | | | 580 |
| EXP | GLVLYNTEK | 97 | 9 | 1 | 100 | 0.0069 | 0.0055 | | | | 581 |
| EXP | GLVLYNTEKGR | 97 | 11 | 1 | 100 | | | | | | 582 |
| EXP | GSGVSSKK | 30 | 8 | 1 | 100 | | | | | | 583 |
| EXP | GSGVSSKKK | 30 | 9 | 1 | 100 | 0.0003 | 0.0065 | 0.0004 | 0.0010 | 0.0002 | 584 |
| EXP | GSGVSSKKKNK | 30 | 11 | 1 | 100 | | | | | | 585 |

TABLE IX-continued

Malaria A03 Super Motif Peptides With Binding Data

| Protein | Sequence | Position | No. of Amino Acids | Sequence Frequency | Conservancy (%) | A*0301 | A*1101 | A*3101 | A*3301 | A*6801 | Seq. Id. |
|---|---|---|---|---|---|---|---|---|---|---|---|
| EXP | GTGSGVSSK | 28 | 9 | 1 | 100 | 0.0039 | 0.0180 | | | | 586 |
| EXP | GTGSGVSSKK | 28 | 10 | 1 | 100 | 0.0071 | 0.0340 | | | | 587 |
| EXP | GTGSGVSSKKK | 28 | 11 | 1 | 100 | | | | | | 588 |
| EXP | GVGLVLYNTEK | 95 | 11 | 1 | 100 | | | | | | 589 |
| EXP | GVSSKKKNK | 32 | 9 | 1 | 100 | 0.0001 | 0.0002 | | | | 590 |
| EXP | GVSSKKKNKK | 32 | 10 | 1 | 100 | 0.0011 | 0.0002 | | | | 591 |
| EXP | IIFNKESLAEK | 14 | 11 | 1 | 100 | | | | | | 592 |
| EXP | LALFFIIFNK | 9 | 10 | 1 | 100 | 0.0140 | 0.0530 | 0.0072 | 0.0076 | 0.0039 | 593 |
| EXP | LISDMIKK | 53 | 8 | 1 | 100 | | | | | | 594 |
| EXP | LVEVNKRK | 64 | 8 | 1 | 100 | | | | | | 595 |
| EXP | LVEVNKRKSK | 64 | 10 | 1 | 100 | 0.0005 | 0.0002 | | | | 596 |
| EXP | LVLYNTEK | 98 | 8 | 1 | 100 | | | | | | 597 |
| EXP | LVLYNTEKGR | 98 | 10 | 1 | 100 | 0.0005 | 0.0002 | | | | 598 |
| EXP | NTEKGRHPFK | 102 | 10 | 1 | 100 | 0.0047 | 0.0080 | | | | 599 |
| EXP | SLAEKTNK | 20 | 8 | 1 | 100 | | | | | | 600 |
| EXP | SSKKKNKK | 34 | 8 | 1 | 100 | | | | | | 601 |
| EXP | VLYNTEKGR | 99 | 9 | 1 | 100 | 0.0110 | 0.0007 | 0.0039 | 0.0055 | 0.0022 | 602 |
| EXP | VSSKKKNK | 33 | 8 | 1 | 100 | | | | | | 603 |
| EXP | VSSKKKNKK | 33 | 9 | 1 | 100 | 0.0001 | 0.0002 | 0.0004 | 0.0010 | 0.0002 | 604 |
| LSA | AIELPSENER | 1660 | 10 | 1 | 100 | 0.0001 | 0.0002 | 0.0009 | 0.0008 | 0.0029 | 605 |
| LSA | DIHKGHLEEK | 1713 | 10 | 1 | 100 | 0.0004 | 0.0002 | 0.0009 | 0.0055 | 0.0046 | 606 |
| LSA | DIHKGHLEEKK | 1713 | 11 | 1 | 100 | | | | | | 607 |
| LSA | DITKYFMK | 1901 | 8 | 1 | 100 | | | | | | 608 |
| LSA | DLDEGIEK | 1818 | 8 | 1 | 100 | | | | | | 609 |
| LSA | DLEEKAAK | 148 | 8 | 1 | 100 | | | | | | 610 |
| LSA | DLEQDRLAK | 1388 | 9 | 1 | 100 | 0.0001 | 0.0002 | | | | 611 |
| LSA | DLEQDRLAKEK | 1388 | 11 | 1 | 100 | | | | | | 612 |
| LSA | DLEQERLAK | 1609 | 9 | 1 | 100 | 0.0001 | 0.0002 | | | | 613 |
| LSA | DLEQERLAKEK | 1609 | 11 | 1 | 100 | | | | | | 614 |
| LSA | DLEQERLANEK | 1524 | 11 | 1 | 100 | | | | | | 615 |
| LSA | DLEQERRAK | 1575 | 9 | 1 | 100 | 0.0001 | 0.0002 | | | | 616 |
| LSA | DLEQERRAKEK | 1575 | 11 | 1 | 100 | | | | | | 617 |
| LSA | DLEQRKADTK | 1626 | 10 | 1 | 100 | 0.0001 | 0.0002 | | | | 618 |
| LSA | DLEQRKADTKK | 1626 | 11 | 1 | 100 | | | | | | 619 |
| LSA | DLERTKASK | 1184 | 9 | 1 | 100 | 0.0001 | 0.0002 | | | | 620 |
| LSA | DSEQERLAK | 521 | 9 | 1 | 100 | 0.0001 | 0.0002 | 0.0004 | 0.0010 | 0.0002 | 621 |
| LSA | DSEQERLAKEK | 521 | 11 | 1 | 100 | | | | | | 622 |
| LSA | DSKEISIIEK | 1689 | 10 | 1 | 100 | 0.0001 | 0.0002 | | | | 623 |
| LSA | DTKKNLER | 1633 | 8 | 1 | 100 | | | | | | 624 |
| LSA | DTKKNLERK | 1633 | 9 | 1 | 100 | 0.0001 | 0.0002 | | | | 625 |
| LSA | DTKKNLERKK | 1633 | 10 | 1 | 100 | 0.0001 | 0.0002 | | | | 626 |
| LSA | DVLAEDLYGR | 1646 | 10 | 1 | 100 | 0.0001 | 0.0002 | | | | 627 |
| LSA | DVNDFQISK | 1751 | 9 | 1 | 100 | 0.0001 | 0.0018 | | | | 628 |
| LSA | EIIKSNLR | 33 | 8 | 1 | 100 | | | | | | 629 |
| LSA | EISIIEKTNR | 1692 | 10 | 1 | 100 | 0.0001 | 0.0002 | | | | 630 |
| LSA | ELEDLIEK | 1805 | 8 | 1 | 100 | | | | | | 631 |
| LSA | ELPSENER | 1662 | 8 | 1 | 100 | | | | | | 632 |
| LSA | ELSEDITK | 1897 | 8 | 1 | 100 | | | | | | 633 |
| LSA | ELSEEKIK | 1829 | 8 | 1 | 100 | | | | | | 634 |
| LSA | ELSEEKIKK | 1829 | 9 | 1 | 100 | 0.0002 | 0.0002 | | | | 635 |
| LSA | ELSEEKIKKGK | 1829 | 11 | 1 | 100 | | | | | | 636 |
| LSA | ELTMSNVK | 83 | 8 | 1 | 100 | | | | | | 637 |
| LSA | ESITTNVEGR | 1702 | 10 | 1 | 100 | 0.0001 | 0.0002 | | | | 638 |
| LSA | ESITTNVEGRR | 1702 | 11 | 1 | 100 | | | | | | 639 |
| LSA | FLKENKLNK | 111 | 9 | 1 | 100 | 0.0260 | 0.0005 | | | | 640 |
| LSA | GSIKPEQK | 1725 | 8 | 1 | 100 | | | | | | 641 |
| LSA | GSIKPEQKEDK | 1725 | 11 | 1 | 100 | | | | | | 642 |
| LSA | GSSNSRNR | 42 | 8 | 1 | 100 | | | | | | 643 |
| LSA | GVSENIFLK | 105 | 9 | 1 | 100 | 0.2700 | 0.6600 | | | | 644 |
| LSA | HIINDDDDK | 126 | 9 | 1 | 100 | 0.0002 | 0.0002 | | | | 645 |
| LSA | HIINDDDDKK | 126 | 10 | 1 | 100 | 0.0001 | 0.0002 | 0.0009 | 0.0009 | 0.0003 | 646 |
| LSA | HIINDDDDKKK | 126 | 11 | 1 | 100 | | | | | | 647 |
| LSA | HIIKKYKNDK | 1860 | 9 | 1 | 100 | 0.0002 | 0.0002 | | | | 648 |
| LSA | HINGKIIK | 20 | 8 | 1 | 100 | | | | | | 649 |
| LSA | HLEEKKDGSIK | 1718 | 11 | 1 | 100 | | | | | | 650 |
| LSA | HVLSHNSYEK | 59 | 10 | 1 | 100 | 0.0170 | 0.0140 | | | | 651 |
| LSA | IINDDDDK | 127 | 8 | 1 | 100 | | | | | | 652 |
| LSA | IINDDDDKK | 127 | 9 | 1 | 100 | 0.0002 | 0.0002 | | | | 653 |
| LSA | IINDDDDKKK | 127 | 10 | 1 | 100 | 0.0001 | 0.0002 | | | | 654 |
| LSA | ISDYNDFQISK | 1749 | 11 | 1 | 100 | | | | | | 655 |
| LSA | ISIIEKTNR | 1693 | 9 | 1 | 100 | 0.0001 | 0.0008 | 0.0320 | 0.0150 | 0.0054 | 656 |
| LSA | ITTNVEGR | 1704 | 8 | 1 | 100 | | | | | | 657 |
| LSA | ITTNVEGRR | 1704 | 9 | 1 | 100 | 0.0002 | 0.0007 | 0.0025 | 0.0043 | 0.3200 | 658 |
| LSA | IVDELSEDITK | 1894 | 11 | 1 | 100 | | | | | | 659 |
| LSA | KADTKKNLER | 1631 | 10 | 1 | 100 | 0.0001 | 0.0002 | 0.0086 | 0.0011 | 0.0003 | 660 |

TABLE IX-continued

Malaria A03 Super Motif Peptides With Binding Data

| Protein | Sequence | Position | No. of Amino Acids | Sequence Frequency | Conservancy (%) | A*0301 | A*1101 | A*3101 | A*3301 | A*6801 | Seq. Id. |
|---|---|---|---|---|---|---|---|---|---|---|---|
| LSA | KADTKKNLERK | 1631 | 11 | 1 | 100 | | | | | | 661 |
| LSA | KIIKNSEK | 24 | 8 | 1 | 100 | | | | | | 662 |
| LSA | KIKKGKKYEK | 1834 | 10 | 1 | 100 | 0.0081 | 0.0007 | 0.0042 | 0.0009 | 0.0003 | 663 |
| LSA | KLQEQQSDLER | 1177 | 11 | 1 | 100 | | | | | | 664 |
| LSA | KSLYDEHIK | 1854 | 9 | 1 | 100 | 0.0005 | 0.0340 | 0.0004 | 0.0010 | 0.0002 | 665 |
| LSA | KSLYDEHIKK | 1854 | 10 | 1 | 100 | 0.0094 | 0.0490 | | | | 666 |
| LSA | KSSEELSEEK | 1825 | 10 | 1 | 100 | 0.0001 | 0.0009 | | | | 667 |
| LSA | KTKDNNFK | 1843 | 8 | 1 | 100 | | | | | | 668 |
| LSA | KTKNNENNK | 68 | 9 | 1 | 100 | 0.0028 | 0.0038 | | | | 669 |
| LSA | LAEDLYGR | 1648 | 8 | 1 | 100 | | | | | | 670 |
| LSA | LAKEKLQEQQR | 1615 | 11 | 1 | 100 | | | | | | 671 |
| LSA | LANEKLQEQQR | 1530 | 11 | 1 | 100 | | | | | | 672 |
| LSA | LIFHINGK | 17 | 8 | 1 | 100 | | | | | | 673 |
| LSA | LIFHINGKIIK | 17 | 11 | 1 | 100 | | | | | | 674 |
| LSA | LLIFHINGK | 16 | 9 | 1 | 100 | 0.0260 | 0.0100 | | | | 675 |
| LSA | LSEDMCYFMK | 1898 | 11 | 1 | 100 | | | | | | 676 |
| LSA | LSEEKIKK | 1830 | 8 | 1 | 100 | | | | | | 677 |
| LSA | LSEEKIKKGK | 1830 | 10 | 1 | 100 | 0.0004 | 0.0002 | | | | 678 |
| LSA | LSEEKIKKGKK | 1830 | 11 | 1 | 100 | | | | | | 679 |
| LSA | LSHNSYEK | 61 | 8 | 1 | 100 | | | | | | 680 |
| LSA | LSHNSYEKTK | 61 | 10 | 1 | 100 | 0.0004 | 0.0002 | | | | 681 |
| LSA | NIFLKENK | 109 | 8 | 1 | 100. | | | | | | 682 |
| LSA | NIFLKENKLNK | 109 | 11 | 1 | 100 | | | | | | 683 |
| LSA | NLDDLDEGIEK | 1815 | 11 | 1 | 100 | | | | | | 684 |
| LSA | NLGVSENIFLK | 103 | 11 | 1 | 100 | | | | | | 685 |
| LSA | NLLIFHINGK | 15 | 10 | 1 | 100 | 0.0049 | 0.0008 | | | | 686 |
| LSA | NLRGSSNSR | 38 | 10 | 1 | 100 | 0.0004 | 0.0002 | | | | 687 |
| LSA | NSEKDEIIK | 28 | 9 | 1 | 100 | 0.0002 | 0.0002 | 0.0004 | 0.0010 | 0.0002 | 688 |
| LSA | NSRNRINEEK | 45 | 10 | 1 | 100 | 0.0004 | 0.0002 | | | | 689 |
| LSA | NVEGRRDIHK | 1707 | 10 | 1 | 100 | 0.0004 | 0.0002 | | | | 690 |
| LSA | NVKNVSQTNFK | 88 | 11 | 1 | 100 | | | | | | 691 |
| LSA | NVSQTNFK | 91 | 8 | 1 | 100 | | | | | | 692 |
| LSA | PAIELPSENER | 1659 | 11 | 1 | 100 | | | | | | 693 |
| LSA | QSDLEQDR | 1386 | 8 | 1 | 100 | | | | | | 694 |
| LSA | QSDLEQDRLAK | 1386 | 11 | 1 | 100 | | | | | | 695 |
| LSA | QSDLEQER | 1590 | 8 | 1 | 100 | | | | | | 696 |
| LSA | QSDSEQERLAK | 1590 | 11 | 1 | 100 | | | | | | 697 |
| LSA | QSDLEQERR | 1573 | 9 | 1 | 100 | 0.0002 | 0.0002 | 0.0006 | 0.0005 | 0.0005 | 698 |
| LSA | QSDLEQERRAK | 1573 | 11 | 1 | 100 | | | | | | 699 |
| LSA | QSDLERTK | 1182 | 8 | 1 | 100 | | | | | | 700 |
| LSA | QSDLERTKASK | 1182 | 11 | 1 | 100 | | | | | | 701 |
| LSA | QSDSEQER | 519 | 8 | 1 | 100 | | | | | | 702 |
| LSA | QSDSEQERLAK | 519 | 11 | 1 | 100 | | | | | | 703 |
| LSA | QSSLPQDNR | 1676 | 9 | 1 | 100 | 0.0002 | 0.0013 | 0.0150 | 0.0140 | 0.0480 | 704 |
| LSA | QTNFKSLLR | 94 | 9 | 1 | 100 | 0.0320 | 0.0440 | 0.0820 | 0.0180 | 0.1300 | 705 |
| LSA | QVNKEKEK | 1869 | 8 | 1 | 100 | | | | | | 706 |
| LSA | QVNKEKEKFIK | 1869 | 11 | 1 | 100 | | | | | | 707 |
| LSA | RINEEKHEK | 49 | 9 | 1 | 100 | 0.0033 | 0.0370 | | | | 708 |
| LSA | RINEEKHEKK | 49 | 10 | 1 | 100 | 0.0024 | 0.0018 | 0.0009 | 0.0009 | 0.0003 | 709 |
| LSA | RSGSSNSR | 40 | 8 | 1 | 100 | | | | | | 710 |
| LSA | RSGSSNSRNR | 40 | 10 | 1 | 100 | 0.0011 | 0.0002 | | | | 711 |
| LSA | SIIEKTNR | 1694 | 8 | 1 | 100 | | | | | | 712 |
| LSA | SIKPEQKEDK | 1726 | 10 | 1 | 100 | 0.0002 | 0.0002 | 0.0009 | 0.0009 | 0.0003 | 713 |
| LSA | SITTNVEGR | 1703 | 9 | 1 | 100 | 0.0002 | 0.0027 | | | | 714 |
| LSA | SITTNVEGRR | 1703 | 10 | 1 | 100 | 0.0002 | 0.0002 | | | | 715 |
| LSA | SLPQDNRGNSR | 1678 | 11 | 1 | 100 | | | | | | 716 |
| LSA | SLYDEHIK | 1855 | 8 | 1 | 100 | | | | | | 717 |
| LSA | SLYDEHIKK | 1855 | 9 | 1 | 100 | 0.0460 | 0.4100 | | | | 718 |
| LSA | SLYDEHIKKYK | 1855 | 11 | 1 | 100 | | | | | | 719 |
| LSA | SSEELSEEK | 1826 | 9 | 1 | 100 | 0.0002 | 0.0017 | 0.0004 | 0.0010 | 0.0002 | 720 |
| LSA | SSEELSEEKIK | 1826 | 11 | 1 | 100 | | | | | | 721 |
| LSA | SSLPQDNR | 1677 | 8 | 1 | 100 | | | | | | 722 |
| LSA | TTNVEGRR | 1705 | 8 | 1 | 100. | | | | | | 723 |
| LSA | VLAEDLYGR | 1647 | 9 | 1 | 100 | 0.0013 | 0.0004 | 0.0083 | 0.0220 | 0.0032 | 724 |
| LSA | VLSHNSYEK | 60 | 9 | 1 | 100 | 0.0280 | 0.0280 | | | | 725 |
| LSA | VLSHNSYEKTK | 60 | 11 | 1 | 100 | | | | | | 726 |
| LSA | VSENIFLK | 106 | 8 | 1 | 100 | | | | | | 727 |
| LSA | VSENIFLKENK | 106 | 11 | 1 | 100 | | | | | | 728 |
| LSA | VSQTNFKSLLR | 92 | 11 | 1 | 100 | | | | | | 729 |
| LSA | YIKGQDENR | 137 | 9 | 1 | 100 | 0.0025 | 0.0002 | | | | 730 |
| SSP2 | ALLACAGLAYK | 509 | 11 | 10 | 100 | | | | | | 731 |
| SSP2 | AVCVEVEK | 233 | 8 | 10 | 100 | | | | | | 732 |
| SSP2 | CSVTCGKGTR | 253 | 10 | 10 | 100 | 0.0002 | 0.0002 | | | | 733 |
| SSP2 | DALLQVRK | 135 | 8 | 9 | 90 | | | | | | 734 |
| SSP2 | DASKNKEK | 106 | 8 | 10 | 100 | | | | | | 735 |

TABLE IX-continued

Malaria A03 Super Motif Peptides With Binding Data

| Protein | Sequence | Position | No. of Amino Acids | Sequence Frequency | Conservancy (%) | A*0301 | A*1101 | A*3101 | A*3301 | A*6801 | Seq. Id. |
|---|---|---|---|---|---|---|---|---|---|---|---|
| SSP2 | DIPKKPENK TABLE X-continued Malaria A24 Super Motif Peptides With Binding Information

| Protein | Sequence | Position | No. of Amino Acids | Sequence Frequency | Conservancy (%) | A*2401 | Seq. Id. |
|---|---|---|---|---|---|---|---|
| CSP | ALFQEYQCY | 18 | 9 | 19 | 100 | | 800 |
| CSP | CYGSSSNTRVL | 25 | 11 | 19 | 100 | | 801 |
| CSP | DIEKKKKM | 402 | 9 | 19 | 100 | | 802 |
| CSP | DYENDIEKKI | 398 | 10 | 18 | 95 | | 803 |
| CSP | ELNYDNAGI | 37 | 9 | 18 | 95 | | 804 |
| CSP | ELNYDNAGINL | 37 | 11 | 18 | 95 | | 805 |
| CSP | EMNYYGKQENW | 52 | 11 | 19 | 100 | | 806 |
| CSP | FLFVEALF | 13 | 8 | 19 | 100 | | 807 |
| CSP | FLFVEALFQEY | 13 | 11 | 19 | 100 | | 808 |
| CSP | FVEALFQEY | 15 | 9 | 19 | 100 | | 809 |
| CSP | GINLYNEL | 44 | 8 | 18 | 95 | | 810 |
| CSP | GINLYNELEM | 44 | 10 | 18 | 95 | | 811 |
| CSP | GLIMVLSF | 425 | 8 | 19 | 100 | | 812 |
| CSP | GLIMVLSFL | 425 | 9 | 19 | 100 | | 813 |
| CSP | GLIMVLSFLF | 425 | 10 | 19 | 100 | | 814 |
| CSP | GLIMVLSFLFL | 425 | 11 | 19 | 100 | | 815 |
| CSP | HIBQYLKKI | 350 | 9 | 15 | 79 | | 816 |
| CSP | ILSVSSFL | 7 | 8 | 19 | 100 | | 817 |
| CSP | ILSVSSFLF | 7 | 9 | 19 | 100 | | 818 |
| CSP | IMVLSFLF | 427 | 8 | 19 | 100 | | 819 |
| CSP | IMVLSFLFL | 427 | 9 | 19 | 100 | 0.0008 | 820 |
| CSP | KIQNSLSTEW | 361 | 10 | 15 | 79 | | 821 |
| CSP | KLAILSVSSF | 4 | 10 | 19 | 100 | | 822 |
| CSP | KLAILSVSSFL | 4 | 11 | 19 | 100 | | 823 |
| CSP | KLRKPKHKKL | 104 | 10 | 19 | 100 | | 824 |
| CSP | KMEKCSSVF | 409 | 9 | 19 | 100 | | 825 |
| CSP | LFQEYQCY | 19 | 8 | 19 | 100 | | 826 |
| CSP | LFVEALFQEY | 14 | 10 | 19 | 100 | | 827 |
| CSP | LIMVLSFL | 426 | 8 | 19 | 100 | | 828 |
| CSP | LIMVLSFLF | 426 | 9 | 19 | 100 | | 829 |
| CSP | LIMVLSFLFL | 426 | 10 | 19 | 100 | | 830 |
| CSP | LYNELEMNY | 47 | 9 | 19 | 100 | | 831 |
| CSP | LYNELEMNYY | 47 | 10 | 19 | 100 | | 832 |
| CSP | MMRKLAIL | 1 | 8 | 19 | 100 | | 833 |
| CSP | MVLSFLFL | 428 | 8 | 19 | 100 | | 834 |
| CSP | NLYNELEM | 46 | 8 | 19 | 100 | | 835 |
| CSP | NLYNELEMNY | 46 | 10 | 19 | 100 | | 836 |
| CSP | NLYNELEMNYY | 46 | 11 | 19 | 100 | | 837 |
| CSP | NTRVLNEL | 31 | 8 | 19 | 100 | | 838 |
| CSP | NTRVLNELNY | 31 | 10 | 19 | 100 | | 839 |
| CSP | NVVNSSIGL | 418 | 9 | 19 | 100 | | 840 |
| CSP | NVVNSSIGLI | 418 | 10 | 19 | 100 | | 841 |
| CSP | NVVNSSIGLIM | 418 | 11 | 19 | 100 | | 842 |
| CSP | NYDNAGINL | 39 | 9 | 18 | 95 | 0.0004 | 843 |
| CSP | NYDNAGINLY | 39 | 10 | 18 | 95 | | 844 |
| CSP | NYYGKQENW | 54 | 9 | 19 | 100 | | 845 |
| CSP | NYYGKQENWY | 54 | 10 | 19 | 100 | | 846 |
| CSP | RVLNELNY | 33 | 8 | 19 | 100 | | 847 |
| CSP | SFLFVEAL | 12 | 8 | 19 | 100 | | 848 |
| CSP | SFLFVEALF | 12 | 9 | 19 | 100 | | 849 |
| CSP | SIGLIMVL | 423 | 8 | 19 | 100 | | 850 |
| CSP | SIGLIMVLSF | 423 | 10 | 19 | 100 | | 851 |
| CSP | SIGLIMVLSFL | 423 | 11 | 19 | 100 | | 852 |
| CSP | SLKKNSRSL | 64 | 9 | 19 | 100 | | 853 |
| CSP | SVFNVVNSSI | 415 | 10 | 19 | 100 | | 854 |
| CSP | SVSSFLFVEAL | 9 | 11 | 19 | 100 | | 855 |
| CSP | SVTCGNGI | 374 | 8 | 19 | 100 | | 856 |
| CSP | VFNVVNSSI | 416 | 9 | 19 | 100 | | 857 |
| CSP | VFNVVNSSIGL | 416 | 11 | 19 | 100 | | 858 |
| CSP | VTCGNGIQVRI | 375 | 11 | 19 | 100 | | 859 |
| CSP | VVNSSIGL | 419 | 8 | 19 | 100 | | 860 |
| CSP | VVNSSIGLI | 419 | 9 | 19 | 100 | | 861 |
| CSP | VVNSSIGLIM | 419 | 10 | 19 | 100 | | 862 |
| CSP | WYSLKKNSRSL | 62 | 11 | 19 | 100 | | 863 |
| CSP | YLKKIQNSL | 358 | 9 | 15 | 79 | | 864 |
| CSP | YYGKQENW | 55 | 8 | 19 | 100 | | 865 |
| CSP | YYGKQENWY | 55 | 9 | 19 | 100 | | 866 |
| CSP | YYGKQENWYSL | 55 | 11 | 19 | 100 | | 867 |
| EXP | ATSVLAGL | 77 | 8 | 1 | 100 | | 868 |
| EXP | ATSVLAGLL | 77 | 9 | 1 | 100 | | 869 |
| EXP | DMIKKEEEL | 56 | 9 | 1 | 100 | | 870 |
| EXP | DVHDLISDM | 49 | 9 | 1 | 100 | | 871 |
| EXP | DVHDLISDMI | 49 | 10 | 1 | 100 | | 872 |
| EXP | EVNKRKSKY | 66 | 9 | 1 | 100 | | 873 |
| EXP | EVNKRKSKYKL | 66 | 11 | 1 | 100 | | 874 |

TABLE X-continued

Malaria A24 Super Motif Peptides With Binding Information

| Protein | Sequence | Position | No. of Amino Acids | Sequence Frequency | Conservancy (%) | A*2401 | Seq. Id. |
|---|---|---|---|---|---|---|---|
| EXP | FFIIFNKESL | 12 | 10 | 1 | 100 | | 875 |

TABLE X-continued

Malaria A24 Super Motif Peptides With Binding Information

| Protein | Sequence | Position | No. of Amino Acids | Sequence

TABLE X-continued

| Malaria A24 Super Motif Peptides With Binding Information | | | | | | | |
|---|---|---|---|---|---|---|---|
| Protein | Sequence | Position | No. of Amino Acids | Sequence Frequency | Conservancy (%) | A*2401 | Seq. Id. |
| LSA | NFQDEENIGI | 1793 | 10 | 1 | 100 | | 1025 |
| LSA | NFQDEENIGIY | 1793 | 11 | 1 | 100 | | 1026 |
| LSA | NIFLKENKL | 109 | 9 | 1 | 100 | | 1027 |
| LSA | NIGIYKEL | 1799 | 8 | 1 | 100 | | 1028 |
| LSA | NIGIYKELEDL | 1799 | 11 | 1 | 100 | | 1029 |
| LSA | NISDVNDF | 1748 | 8 | 1 | 100 | | 1030 |
| LSA | NISDVNDFQI | 1748 | 10 | 1 | 100 | | 1031 |
| LSA | NLDDLDEGI | 1815 | 9 | 1 | 100 | | 1032 |
| LSA | NLGVSENI | 103 | 8 | 1 | 100 | | 1033 |
| LSA | NLGVSENIF | 103 | 9 | 1 | 100 | | 1034 |
| LSA | NLGVSENIFL | 103 | 10 | 1 | 100 | | 1035 |
| LSA | NLLIFHINGKI | 15 | 11 | 1 | 100 | | 1036 |
| LSA | NVEGRRDI | 1707 | 8 | 1 | 100 | | 1037 |
| LSA | NVKNVSQTNF | 88 | 10 | 1 | 100 | | 1038 |
| LSA | NVSQTNFKSL | 91 | 10 | 1 | 100 | | 1039 |
| LSA | NVSQTNFKSLL | 91 | 11 | 1 | 100 | | 1040 |
| LSA | PIVQYDNF | 1787 | 8 | 1 | 100 | | 1041 |
| LSA | QISKYEDEI | 1756 | 9 | 1 | 100 | | 1042 |
| LSA | QIVDELSEDI | 1893 | 10 | 1 | 100 | | 1043 |
| LSA | QTNFKSLL | 94 | 8 | 1 | 100 | | 1044 |
| LSA | QTNFKSLLRNL | 94 | 11 | 1 | 100 | | 1045 |
| LSA | QVNKEKEKF | 1869 | 9 | 1 | 100 | | 1046 |
| LSA | QVNKEKEKFI | 1869 | 10 | 1 | 100 | | 1047 |
| LSA | QYDNFQDEENI | 1790 | 11 | 1 | 100 | | 1048 |
| LSA | RLEIPAIEL | 1655 | 9 | 1 | 100 | | 1049 |
| LSA | RTKASKETL | 1187 | 9 | 1 | 100 | | 1050 |
| LSA | SFYFILVNL | 8 | 9 | 1 | 100 | | 1051 |
| LSA | SFYFILVNLL | 8 | 10 | 1 | 100 | | 1052 |
| LSA | SFYFILVNLLI | 8 | 11 | 1 | 100 | | 1053 |
| LSA | SIIEKTNRESI | 1694 | 11 | 1 | 100 | | 1054 |
| LSA | SLYDEHIKKY | 1855 | 10 | 1 | 100 | | 1055 |
| LSA | TLQEQQSDL | 1194 | 9 | 1 | 100 | | 1056 |
| LSA | TLQGQQSDL | 157 | 9 | 1 | 100 | | 1057 |
| LSA | TINVEGRRDI | 1705 | 10 | 1 | 100 | | 1058 |
| LSA | TVNISDVNDF | 1746 | 10 | 1 | 100 | | 1059 |
| LSA | VLAEDLYGRL | 1647 | 10 | 1 | 100 | | 1060 |
| LSA | YFILVNLL | 10 | 8 | 1 | 100 | | 1061 |
| LSA | YFILVNLLI | 10 | 9 | 1 | 100 | | 1062 |
| LSA | YFILVNLLIF | 10 | 10 | 1 | 100 | | 1063 |
| LSA | YIPHQSSL | 1672 | 8 | 1 | 100 | | 1064 |
| LSA | YISFYFIL | 6 | 8 | 1 | 100 | | 1065 |
| LSA | YISFYFILVNL | 6 | 11 | 1 | 100 | | 1066 |
| LSA | YYIPHQSSL | 1671 | 9 | 1 | 100 | 4.3000 | 1067 |
| SSP2 | ALLACAGL | 509 | 8 | 10 | 100 | | 1068 |
| SSP2 | ALIACAGLAY | 509 | 10 | 10 | 100 | | 1069 |
| SSP2 | ALLQVRKHL | 136 | 9 | 9 | 90 | | 1070 |
| SSP2 | AMKLIQQL | 72 | 8 | 8 | 100 | | 1071 |
| SSP2 | AMKLIQQLNL | 72 | 10 | 10 | 100 | 0.0006 | 1072 |
| SSP2 | ATPYAGEPAPF | 526 | 11 | 8 | 80 | | 1073 |
| SSP2 | AVFGIGQGI | 186 | 9 | 10 | 100 | | 1074 |
| SSP2 | AVPLAMKL | 68 | 8 | 10 | 100 | | 1075 |
| SSP2 | AVPLAMKLI | 68 | 9 | 10 | 100 | | 1076 |
| SSP2 | AWENVKNVI | 219 | 9 | 10 | 100 | | 1077 |
| SSP2 | DLDEPEQF | 546 | 8 | 10 | 100 | | 1078 |
| SSP2 | DLDEPEQFRL | 546 | 10 | 10 | 100 | | 1079 |
| SSP2 | DVQNNIVDEI | 27 | 10 | 10 | 100 | | 1080 |
| SSP2 | EILHEGCTSEL | 267 | 11 | 8 | 80 | | 1081 |
| SSP2 | ETLGEEDKDL | 538 | 10 | 10 | 100 | | 1082 |
| SSP2 | EVCNDEVDL | 41 | 9 | 8 | 80 | | 1083 |
| SSP2 | EVCNDEVDLY | 41 | 10 | 8 | 80 | | 1084 |
| SSP2 | EVCNDEVDLYL | 41 | 11 | 8 | 80 | | 1085 |
| SSP2 | EVDLYLLM | 46 | 8 | 8 | 80 | | 1086 |
| SSP2 | EVEKTASCGVW | 237 | 11 | 10 | 100 | | 1087 |
| SSP2 | FLIFFDLF | 14 | 8 | 10 | 100 | | 1088 |
| SSP2 | FLIFFDLFL | 14 | 9 | 10 | 100 | | 1089 |
| SSP2 | FVVPGAATPY | 520 | 10 | 8 | 80 | | 1090 |
| SSP2 | GIAGGLAL | 503 | 8 | 10 | 100 | | 1091 |
| SSP2 | GIAGGLALL | 503 | 9 | 10 | 100 | | 1092 |
| SSP2 | GIGQGINVAF | 189 | 10 | 10 | 100 | | 1093 |
| SSP2 | GINVAFNRF | 193 | 9 | 10 | 100 | | 1094 |
| SSP2 | GINVAFNRFL | 193 | 10 | 10 | 100 | | 1095 |
| SSP2 | GIPDSIQDSL | 163 | 10 | 10 | 100 | | 1096 |
| SSP2 | GLALLACAGL | 507 | 10 | 10 | 100 | | 1097 |
| SSP2 | GTRSRKREI | 260 | 9 | 10 | 100 | | 1098 |
| SSP2 | GTRSRKREIL | 260 | 10 | 10 | 100 | | 1099 |

TABLE X-continued

| Protein | Sequence | Position | No. of Amino Acids | Sequence Frequency | Conservancy (%) | A*2401 | Seq. Id. |
|---|---|---|---|---|---|---|---|
| Malaria A24 Super Motif Peptides With Binding Information | | | | | | | |
| SSP2 | GVKIAVFGI | 182 | 9 | 10 | 100 | | 1100 |
| SSP2 | HLGNVKYL | 3 | 8 | 10 | 100 | | 1101 |
| SSP2 | HLGNVKYLVI | 3 | 10 | 10 | 100 | | 1102 |
| SSP2 | ILHEGCTSEL | 268 | 10 | 8 | 80 | | 1103 |
| SSP2 | ILTDGIPDS1 | 159 | 10 | 10 | 100 | | 1104 |
| SSP2 | IVFLIFFDL | 12 | 9 | 10 | 100 | | 1105 |
| SSP2 | IVFLIFFDLF | 12 | 10 | 10 | 100 | | 1106 |
| SSP2 | IVFLIFFDLFL | 12 | 11 | 10 | 100 | | 1107 |
| SSP2 | KFVVPGAATPY | 519 | 11 | 8 | 80 | | 1108 |
| SSP2 | KIAGGIAGGL | 499 | 10 | 10 | 100 | | 1109 |
| SSP2 | KIAVFGIGQGI | 184 | 11 | 10 | 100 | | 1110 |
| SSP2 | KLIQQLNL | 74 | 8 | 10 | 100 | | 1111 |
| SSP2 | KTASCGVW | 240 | 8 | 10 | 100 | | 1112 |
| SSP2 | KTASCGVWDEW | 240 | 11 | 10 | 100 | | 1113 |
| SSP2 | KYKIAGGI | 497 | 8 | 9 | 90 | | 1114 |
| SSP2 | KYLVIVFL | 8 | 8 | 10 | 100 | | 1115 |
| SSP2 | KYLVIVFLI | 8 | 9 | 10 | 100 | 4.6000 | 1116 |
| SSP2 | KYLVIVFLIF | 8 | 10 | 10 | 100 | 0.0003 | 1117 |
| SSP2 | KYLVIVFLIFF | 8 | 11 | 10 | 100 | | 1118 |
| SSP2 | LIFFDLFL | 15 | 8 | 10 | 100 | | 1119 |
| SSP2 | LLACAGLAY | 510 | 9 | 10 | 100 | | 1120 |
| SSP2 | LLACAGLAYKF | 510 | 11 | 10 | 100 | | 1121 |
| SSP2 | LLMDCSGSI | 51 | 9 | 10 | 100 | | 1122 |
| SSP2 | LLQVRKHL | 137 | 8 | 9 | 90 | | 1123 |
| SSP2 | LLSTNLPY | 121 | 8 | 9 | 90 | | 1124 |
| SSP2 | LMDCSGSI | 52 | 8 | 10 | 100 | | 1125 |
| SSP2 | LTDGIPDSI | 160 | 9 | 10 | 100 | | 1126 |
| SSP2 | LVIVFLIF | 10 | 8 | 10 | 100 | | 1127 |
| SSP2 | LVIVFLIFF | 10 | 9 | 10 | 100 | | 1128 |
| SSP2 | LVIVFLIFFDL | 10 | 11 | 10 | 100 | | 1129 |
| SSP2 | LVNGRDVQNNI | 22 | 11 | 10 | 100 | | 1130 |
| SSP2 | LVVILTDGI | 156 | 9 | 10 | 100 | | 1131 |
| SSP2 | LYLLMDCSGSI | 49 | 11 | 9 | 90 | | 1132 |
| SSP2 | NIVDEIKY | 31 | 8 | 10 | 100 | | 1133 |
| SSP2 | NLPYGRTNL | 125 | 9 | 8 | 80 | | 1134 |
| SSP2 | NLYADSAW | 213 | 8 | 10 | 100 | | 1135 |
| SSP2 | NVAFNRFL | 195 | 8 | 10 | 100 | | 1136 |
| SSP2 | NVKNVIGPF | 222 | 9 | 10 | 100 | | 1137 |
| SSP2 | NVKNVIGPFM | 222 | 10 | 10 | 100 | | 1138 |
| SSP2 | NVKYLVIVF | 6 | 9 | 10 | 100 | | 1139 |
| SSP2 | NVKYLVIVFL | 6 | 10 | 10 | 100 | | 1140 |
| SSP2 | NVKYLVIVFLI | 6 | 11 | 10 | 100 | | 1141 |
| SSP2 | NWVNHAVPL | 63 | 9 | 8 | 80 | | 1142 |
| SSP2 | NWVNHAVPLAM | 63 | 11 | 8 | 80 | | 1143 |
| SSP2 | PLAMKLIQQL | 70 | 10 | 10 | 100 | | 1144 |
| SSP2 | PYAGEPAPF | 528 | 9 | 8 | 80 | 0.0370 | 1145 |
| SSP2 | QFRLPEENEW | 552 | 10 | 10 | 100 | | 1146 |
| SSP2 | QLVVILTDGI | 155 | 10 | 10 | 100 | | 1147 |
| SSP2 | QVRKHLNDRI | 139 | 10 | 9 | 90 | | 1148 |
| SSP2 | RINRENANQL | 147 | 10 | 10 | 100 | | 1149 |
| SSP2 | RLPEENEW | 554 | 8 | 10 | 100 | | 1150 |
| SSP2 | SLKESRKL | 171 | 8 | 9 | 90 | | 1151 |
| SSP2 | SLLSTNLPY | 120 | 9 | 9 | 90 | | 1152 |
| SSP2 | STNLPYGRTNL | 123 | 11 | 8 | 80 | | 1153 |
| SSP2 | TLGEEDKDL | 539 | 9 | 10 | 100 | | 1154 |
| SSP2 | VFGIGQGI | 187 | 8 | 10 | 100 | | 1155 |
| SSP2 | VFLIFFDL | 13 | 8 | 10 | 100 | | 1156 |
| SSP2 | VFLIFFDLF | 13 | 9 | 10 | 100 | | 1157 |
| SSP2 | VFLIFFDLFL | 13 | 10 | 10 | 100 | | 1158 |
| SSP2 | VILTDGIPDSI | 158 | 11 | 10 | 100 | | 1159 |
| SSP2 | VIVFLIFF | 11 | 8 | 10 | 100 | | 1160 |
| SSP2 | VIVFLIFFDL | 11 | 10 | 10 | 100 | | 1161 |
| SSP2 | VIVFLIFFDLF | 11 | 11 | 10 | 100 | | 1162 |
| SSP2 | VVILTDGI | 157 | 8 | 10 | 100 | | 1163 |
| SSP2 | VVPGAATPY | 521 | 9 | 8 | 80 | | 1164 |
| SSP2 | WVNHAVPL | 64 | 8 | 8 | 80 | | 1165 |
| SSP2 | WVNHAVPLAM | 64 | 10 | 8 | 80 | | 1166 |
| SSP2 | YLLMDCSGSI | 50 | 10 | 10 | 100 | | 1167 |
| SSP2 | YLVIVFLI | 9 | 8 | 10 | 100 | | 1168 |
| SSP2 | YLVIVFLIF | 9 | 9 | 10 | 100 | | 1169 |
| SSP2 | YLVIVFLIFF | 9 | 10 | 10 | 100 | | 1170 |

TABLE XI

Malaria B07 Super Motif Peptides With Binding Information

| Protein | Sequence | Position | No of Amino Acids | Sequence Frequency | Conservancy (%) | B*0702 | Seq. Id. |
|---|---|---|---|---|---|---|---|
| CSP | EPSDKHIEQY | 345 | 10 | 15 | 79 | | 1171 |
| CSP | EPSDKHIEQYL | 345 | 11 | 15 | 79 | | 1172 |
| CSP | DPNANPNA | 202 | 8 | 19 | 100 | | 1171 |
| CSP | DPNANPNV | 130 | 8 | 19 | 100 | | 1174 |
| CSP | DPNRNVDENA | 327 | 10 | 19 | 100 | 0.0002 | 1175 |
| CSP | MPNDPNRNV | 324 | 9 | 19 | 100 | 0.0001 | 1176 |
| CSP | NPDPNANPNV | 120 | 10 | 19 | 100 | 0.0001 | 1177 |
| CSP | NPNANPNA | 302 | 8 | 19 | 100 | 0.0001 | 1178 |
| CSP | NPNVDPNA | 198 | 8 | 19 | 100 | 0.0001 | 1179 |
| CSP | QPGDGNPDPNA | 115 | 11 | 19 | 100 | | 1180 |
| CSP | SPCSVTCGNGI | 371 | 11 | 19 | 100 | | 1181 |
| EXP | DPADNANPDA | 116 | 10 | 1 | 100 | 0.0002 | 1182 |
| EXP | DPQVTAQDV | 136 | 9 | 1 | 100 | 0.0001 | 1183 |
| EXP | EPLIDVHDL | 45 | 9 | 1 | 100 | 0.0001 | 1184 |
| EXP | EPLIDVHDLI | 45 | 10 | 1 | 100 | 0.0002 | 1185 |
| EXP | EPNADPQV | 132 | 8 | 1 | 100 | 0.0001 | 1186 |
| EXP | EPNADPQVTA | 132 | 10 | 1 | 100 | 0.0002 | 1187 |
| EXP | HPFKIGSSDPA | 108 | 11 | 1 | 100 | | 1188 |
| EXP | QPQGDDNNL | 148 | 9 | 1 | 100 | 0.0001 | 1189 |
| EXP | QPQGDDNNLV | 148 | 10 | 1 | 100 | 0.0002 | 1190 |
| LSA | KPEQKEDKSA | 1728 | 10 | 1 | 100 | 0.0002 | 1191 |
| LSA | KPIVQYDNF | 1786 | 9 | 1 | 100 | 0.0001 | 1192 |
| LSA | KPNDKSLY | 1850 | 8 | 1 | 100 | 0.0004 | 1193 |
| LSA | LPSENERGY | 1663 | 9 | 1 | 100 | 0.0001 | 1194 |
| LSA | LPSENERGYY | 1663 | 10 | 1 | 100 | 0.0001 | 1195 |
| LSA | LPSENERGYYI | 1663 | 11 | 1 | 100 | | 1196 |
| SSP2 | EPAPFDETL | 532 | 9 | 10 | 100 | 0.0001 | 1197 |
| SSP2 | GPFMKAVCV | 228 | 9 | 10 | 100 | 0.0023 | 1198 |
| SSP2 | GPFMKAVCVEV | 228 | 11 | 10 | 100 | | 1199 |
| SSP2 | HPSDGKCNL | 206 | 9 | 10 | 100 | 0.0220 | 1200 |
| SSP2 | HPSDGKCNLY | 206 | 10 | 10 | 100 | 0.0001 | 1201 |
| SSP2 | HPSDGKCNLYA | 206 | 11 | 10 | 100 | | 1202 |
| SSP2 | IPDSIQDSL | 164 | 9 | 10 | 100 | 0.0022 | 1203 |
| SSP2 | IPEDSEKEV | 367 | 9 | 10 | 100 | 0.0001 | 1204 |
| SSP2 | LPYGRTNL | 126 | 8 | 8 | 80 | 0.1100 | 1205 |
| SSP2 | NPEDDREENF | 382 | 10 | 10 | 100 | 0.0001 | 1206 |
| SSP2 | QPRPRGDNF | 303 | 9 | 9 | 90 | 0.0160 | 1207 |
| SSP2 | QPRPRGDNFA | 303 | 10 | 9 | 90 | 0.0009 | 1208 |
| SSP2 | QPRPRGDNFAV | 303 | 11 | 9 | 90 | | 1209 |
| SSP2 | RPRGDNFA | 305 | 8 | 9 | 90 | 0.0110 | 1210 |
| SSP2 | RPRGDNFAV | 305 | 9 | 9 | 90 | 0.4800 | 1211 |
| SSP2 | TPYAGEPA | 527 | 8 | 8 | 80 | | 1212 |
| SSP2 | TPYAGEPAPF | 527 | 0 | 8 | 80 | 0.0990 | 1213 |
| SSP2 | VPGAATPY | 522 | 8 | 8 | 80 | | 1214 |
| SSP2 | VPGAATPYA | 522 | 9 | 8 | 80 | 0.0001 | 1215 |
| SSP2 | VPLAMKLI | 69 | 8 | 10 | 100 | 0.0001 | 1216 |
| SSP2 | VPLAMKLIQQL | 69 | 11 | 10 | 100 | | 1217 |

TABLE XII

Malaria B27 Super Motif Peptides

| Protein | Sequence | Position | No. of Amino Acids | Sequence Frequency | Conservancy (%) | Seq. Id |
|---|---|---|---|---|---|---|
| CSP | CKMEKCSSVF | 408 | 10 | 19 | 100 | 1218 |
| CSP | DKHIEQYL | 348 | 8 | 15 | 79 | 1219 |
| CSP | DKHIEQYLKKI | 348 | 11 | 15 | 79 | 1220 |
| CSP | EKLRKFKHKKL | 103 | 11 | 19 | 100 | 1221 |
| CSP | GKQENWYSL | 57 | 9 | 19 | 100 | 1222 |
| CSP | KHIEQYLKKI | 349 | 10 | 15 | 79 | 1223 |
| CSP | KKIQNSLSTEW | 360 | 11 | 15 | 79 | 1224 |
| CSP | LKKIQNSL | 359 | 8 | 15 | 79 | 1225 |
| CSP | LKKNSRSL | 65 | 8 | 19 | 100 | 1226 |
| CSP | LRKPKHKKL | 105 | 9 | 19 | 100 | 1227 |
| CSP | RKLAILSVSSF | 3 | 11 | 19 | 100 | 1228 |
| CSP | RKPKHKKL | 106 | 8 | 19 | 100 | 1229 |
| CSP | TRVLNELNY | 32 | 9 | 19 | 100 | 1230 |
| EXP | EKGRHPFKI | 104 | 9 | 1 | 100 | 1231 |
| EXP | KKGSGEPL | 40 | 8 | 1 | 100 | 1232 |
| EXP | KKGSGEPLI | 40 | 9 | 1 | 100 | 1233 |
| EXP | KKNKKGSGEPL | 37 | 11 | 1 | 100 | 1234 |

TABLE XII-continued

Malaria B27 Super Motif Peptides

| Protein | Sequence | Position | No. of Amino Acids | Sequence Frequency | Conservancy (%) | Seq. Id |
|---|---|---|---|---|---|---|
| EXP | KRKSKYKL | 69 | 8 | 1 | 100 | 1235 |
| EXP | MKILSVFF | 1 | 8 | 1 | 100 | 1236 |
| EXP | MKILSVFFL | 1 | 9 | 1 | 100 | 1237 |
| EXP | MKILSVFFLAL | 1 | 11 | 1 | 100 | 1238 |
| EXP | NKKGSGEPL | 39 | 9 | 1 | 100 | 1239 |
| EXP | NIUCGSGEPLI | 39 | 10 | 1 | 100 | 1240 |
| EXP | NKRKSKYKL | 68 | 9 | 1 | 100 | 1241 |
| EXP | SKYKLATSVL | 72 | 10 | 1 | 100 | 1242 |
| EXP | VHDLISDM | 50 | 8 | 1 | 100 | 1243 |
| EXP | VHDLISDMI | 50 | 9 | 1 | 100 | 1244 |
| EXP | YKLATSVL | 74 | 8 | 1 | 100 | 1245 |
| EXP | YKLATSVLAGL | 74 | 11 | 1 | 100 | 1246 |
| LSA | DKDKELTM | 79 | 8 | 1 | 100 | 1247 |
| LSA | DKQVNKEKEKF | 1867 | 11 | 1 | 100 | 1248 |
| LSA | DKSADIQNHTL | 1734 | 11 | 1 | 100 | 1249 |
| LSA | DKSLYDEHI | 1853 | 9 | 1 | 100 | 1250 |
| LSA | DRLAKEKL | 1392 | 8 | 1 | 100 | 1251 |
| LSA | EHGDVLAEDL | 1643 | 10 | 1 | 100 | 1252 |
| LSA | EHGDVLAEDLY | 1643 | 11 | 1 | 100 | 1253 |
| LSA | EKAAKETL | 151 | 8 | 1 | 100 | 1254 |
| LSA | EKDEIIKSNL | 30 | 10 | 1 | 100 | 1255 |
| ISA | EKEKFIKSL | 1873 | 9 | 1 | 100 | 1256 |
| LSA | EKEKFIKSLF | 1873 | 10 | 1 | 100 | 1257 |
| LSA | EKFIKSLF | 1875 | 8 | 1 | 100 | 1258 |
| LSA | EKFIKSLFHI | 1875 | 10 | 1 | 100 | 1259 |
| LSA | EKFIKSLFHIF | 1875 | 11 | 1 | 100 | 1260 |
| LSA | EKHEKKHVL | 53 | 9 | 1 | 100 | 1261 |
| LSA | EKIKKGKKY | 1833 | 9 | 1 | 100 | 1262 |
| LSA | EKKHVLSHNSY | 56 | 11 | 1 | 100 | 1263 |
| LSA | EKLQEQQRDL | 1618 | 10 | 1 | 100 | 1264 |
| LSA | EKLQEQQSDL | 1584 | 10 | 1 | 100 | 1265 |
| LSA | SCLQGQQSDL | 1125 | 10 | 1 | 100 | 1266 |
| LSA | EKNENLDDL | 1811 | 9 | 1 | 100 | 1267 |
| LSA | EKTKDNNF | 1842 | 8 | 1 | 100 | 1268 |
| LSA | EKTKNNENNKF | 67 | 11 | 1 | 100 | 1269 |
| LSA | EKTNRESI | 1697 | 8 | 1 | 100 | 1270 |
| LSA | ERKKEHGDVL | 1639 | 10 | 1 | 100 | 1271 |
| LSA | ERLAKEKL | 1613 | 8 | 1 | 100 | 1272 |
| LSA | ERLANEKL | 1528 | 8 | 1 | 100 | 1273 |
| LSA | ERRAKEKL | 1579 | 8 | 1 | 100 | 1274 |
| LSA | ERIXASKETL | 1186 | 10 | 1 | 100 | 1275 |
| LSA | FHIFDGDNEI | 1882 | 10 | 1 | 100 | 1276 |
| LSA | FHIFDGDNEIL | 1882 | 11 | 1 | 100 | 1277 |
| LSA | FHINGKII | 19 | 8 | 1 | 100 | 1278 |
| LSA | FKPIVQYDNF | 1785 | 10 | 1 | 100 | 1279 |
| LSA | FKPNDKSL | 1849 | 8 | 1 | 100 | 1280 |
| LSA | FKPNDKSLY | 1849 | 9 | 1 | 100 | 1281 |
| LSA | FKSLLRNL | 97 | 8 | 1 | 100 | 1282 |
| LSA | GHLEEKKDOSI | 1717 | 11 | 1 | 100 | 1283 |
| LSA | GKLIHIII | 121 | 8 | 1 | 100 | 1284 |
| LSA | GRLEIPAI | 1654 | 8 | 1 | 100 | 1285 |
| LSA | GRLEIPAIEL | 1654 | 10 | 1 | 100 | 1286 |
| LSA | GRRDIHKGHL | 1710 | 10 | 1 | 100 | 1287 |
| LSA | IKNSEKDEI | 26 | 9 | 1 | 100 | 1288 |
| LSA | IKNSEKDEII | 26 | 10 | 1 | 100 | 1289 |
| LSA | IKSLFHIF | 1878 | 8 | 1 | 100 | 1290 |
| LSA | KHEKKHVL | 54 | 8 | 1 | 100 | 1291 |
| LSA | KHILYISF | 2 | 8 | 1 | 100 | 1292 |
| LSA | KHILYISFY | 2 | 9 | 1 | 100 | 1293 |
| LSA | KHILYISFYF | 2 | 10 | 1 | 100 | 1294 |
| LSA | KHILYISFYFI | 2 | 11 | 1 | 100 | 1295 |
| LSA | KHVLSHNSY | 58 | 9 | 1 | 100 | 1296 |
| LSA | KKEHGDVL | 1641 | 8 | 1 | 100 | 1297 |
| LSA | KKHVLSHNSY | 57 | 10 | 1 | 100 | 1298 |
| LSA | KKYEKTKDNNF | 1839 | 11 | 1 | 100 | 1299 |
| LSA | LRNLGVSENI | 101 | 10 | 1 | 100 | 1300 |
| LSA | LRNLGVSENIF | 101 | 11 | 1 | 100 | 1301 |
| LSA | MKHILYISF | 1 | 9 | 1 | 100 | 1302 |
| LSA | MKHILYISFY | 1 | 10 | 1 | 100 | 1303 |
| LSA | MKHILYISFYF | 1 | 11 | 1 | 100 | 1304 |
| LSA | NHTLETVNI | 1741 | 9 | 1 | 100 | 1305 |
| LSA | NKEGKLIEHI | 118 | 10 | 1 | 100 | 1306 |
| LSA | NKEGKLIEHII | 118 | 11 | 1 | 100 | 1307 |
| LSA | NKEKEKFI | 1871 | 8 | 1 | 100 | 1308 |
| LSA | NKEKEKFIKSL | 1871 | 11 | 1 | 100 | 1309 |

TABLE XII-continued

Malaria B27 Super Motif Peptides

| Protein | Sequence | Position | No. of Amino Acids | Sequence Frequency | Conservancy (%) | Seq. Id |
|---|---|---|---|---|---|---|
| LSA | NKFFDKDKEL | 75 | 10 | 1 | 100 | 1310 |
| LSA | NKLNKI3GKL | 115 | 9 | 1 | 100 | 1311 |
| LSA | NKLNKEGKLI | 115 | 10 | 1 | 100 | 1312 |
| LSA | NRGNSRDSKEI | 1683 | 11 | 1 | 100 | 1313 |
| LSA | QKEDILSADI | 1731 | 9 | 1 | 100 | 1314 |
| LSA | QRDLEQERL | 1607 | 9 | 1 | 100 | 1315 |
| LSA | QRKADTKKNL | 1629 | 10 | 1 | 100 | 1316 |
| LSA | FUCADIKKNL | 1630 | 9 | 1 | 100 | 1317 |
| LSA | RKKEHODVL | 1640 | 9 | 1 | 100 | 1318 |
| LSA | RRDTHKGHL | 1711 | 9 | 1 | 100 | 1319 |
| LSA | SKYEDEISAEY | 1758 | 11 | 1 | 100 | 1320 |
| LSA | SRDSKEISI | 1687 | 9 | 1 | 100 | 1321 |
| LSA | SRDSKEISII | 1687 | 10 | 1 | 100 | 1322 |
| LSA | TKASKED | 1188 | 8 | 1 | 100 | 1323 |
| LSA | TKNNENNKF | 69 | 9 | 1 | 100 | 1324 |
| LSA | TKNNENNKFF | 69 | 10 | 1 | 100 | 1325 |
| LSA | VKNVSQTNF | 89 | 9 | 1 | 100 | 1326 |
| LSA | YKELEDLI | 1803 | 8 | 1 | 100 | 1327 |
| SSP2 | CHPSDGKCNL | 205 | 10 | 10 | 100 | 1328 |
| SSP2 | CHPSDGKCNLY | 205 | 11 | 10 | 100 | 1329 |
| SSP2 | DIOLDEPEQF | 544 | 10 | 10 | 100 | 1330 |
| SSP2 | DREENFDI | 386 | 8 | 10 | 100 | 1331 |
| SSP2 | DROVKIAVF | 180 | 9 | 9 | 90 | 1332 |
| SSP2 | DRGVKIAVFGI | 180 | 11 | 9 | 90 | 1333 |
| SSP2 | DRINRENANQL | 146 | 11 | 10 | 100 | 1334 |
| SSP2 | EKTASCGVW | 239 | 9 | 10 | 100 | 1335 |
| SSP2 | FRLPEENEW | 553 | 9 | 10 | 100 | 1336 |
| SSP2 | GKCNLYADSAW | 210 | 11 | 10 | 100 | 1337 |
| SSP2 | GKGIRSRKREI | 258 | 11 | 10 | 100 | 1338 |
| SSP2 | GRDVQNNI | 25 | 8 | 10 | 100 | 1339 |
| SSP2 | GRNNENRSY | 458 | 9 | 10 | 100 | 1340 |
| SSP2 | KHDNQNNL | 400 | 8 | io | 100 | 1341 |
| SSP2 | LHEGCTSEL | 269 | 9 | 8 | 80 | 1342 |
| SSP2 | MKLIQQLNL | 73 | 9 | 10 | 100 | 1343 |
| SSP2 | NHAVPLAM | 66 | 8 | 8 | 80 | 1344 |
| SSP2 | NHAVPLAMKL | 66 | 10 | 8 | 80 | 1345 |
| SSP2 | NHAVPLAMKLI | 66 | 11 | 8 | 80 | 1346 |
| SSP2 | NHIXINVKY | 2 | 8 | 10 | 100 | 1347 |
| SSP2 | NHLGNVKYL | 2 | 9 | 10 | 100 | 1348 |
| SSP2 | NHLGNVKYLVI | 2 | 11 | 10 | 100 | 1349 |
| SSP2 | NKEKALII | 110 | 8 | 9 | 90 | 1350 |
| SSP2 | NKEKALIII | 110 | 9 | 9 | 90 | 1351 |
| SSP2 | NKHDNQNNL | 399 | 9 | 10 | 100 | 1352 |
| SSP2 | NKYKIAGGI | 496 | 9 | 9 | 90 | 1353 |
| SSP2 | NRENANQL | 149 | 8 | 10 | 100 | 1354 |
| SSP2 | NRENANQLVVI | 149 | 11 | 10 | 100 | 1355 |
| SSP2 | PHGRNNENRSY | 456 | 11 | 10 | 100 | 1356 |
| SSP2 | PRPRGDNF | 304 | 8 | 9 | 90 | 1357 |
| SSP2 | RHNWVNHAVPL | 61 | 11 | 8 | 80 | 1358 |
| SSP2 | RKHLNDRI | 141 | 8 | 10 | 100 | 1359 |
| SSP2 | SKNKEKAL | 108 | 8 | 10 | 100 | 1360 |
| SSP2 | SKNKSKALI | 108 | 9 | 9 | 90 | 1361 |
| SSP2 | SKNKEKALII | 108 | 10 | 9 | 90 | 1362 |
| SSP2 | SKNKEKALIII | 108 | 11 | 9 | 90 | 1363 |
| SSP2 | TRSRKREI | 261 | 8 | 10 | 100 | 1364 |
| SSP2 | TRSRKREIL | 261 | 9 | 10 | 100 | 1365 |
| SSP2 | VKIAVFGI | 183 | 8 | 10 | 100 | 1366 |
| SSP2 | VKNVIGPF | 223 | 8 | 10 | 100 | 1367 |
| SSP2 | VKNVIGPFM | 223 | 9 | 10 | 100 | 1368 |
| SSP2 | VKYLVIVF | 7 | 8 | 10 | 100 | 1369 |
| SSP2 | VKYLVIVFL | 7 | 9 | 10 | 100 | 1370 |
| SSP2 | VKYLVIVFLI | 7 | 10 | 10 | 100 | 1371 |
| SSP2 | VKYLVIVFLIF | 7 | 11 | 10 | 100 | 1372 |
| SSP2 | VRKHLNDRI | 140 | 9 | 10 | 100 | 1373 |
| SSP2 | YKIAGGIAGGL | 498 | 11 | 10 | 100 | 1374 |

TABLE XIII

Malaria B58 Super Motif Peptides

| Protein | Sequence | Position | No. of Amino Acids | Sequence Frequency | Conservancy (%) | Seq. Id |
|---|---|---|---|---|---|---|
| CSP | CSSVFNVV | 413 | 8 | 19 | 100 | 1375 |
| CSP | CSYTCONGI | 373 | 9 | 19 | 100 | 1376 |
| CSP | CSVTCONGIQV | 373 | 11 | 19 | 100 | 1377 |
| CSP | EALFQEYQCY | 17 | 10 | 19 | 100 | 1378 |
| CSP | GSSSNTRV | 27 | 8 | 19 | 100 | 1379 |
| CSP | GSSSNTRVL | 27 | 9 | 19 | 100 | 1380 |
| CSP | LAILSVSSF | 5 | 9 | 19 | 100 | 1381 |
| CSP | LAILSVSSFL | 5 | 10 | 19 | 100 | 1382 |
| CSP | LAILSVSSFLF | 5 | 11 | 19 | 100 | 1383 |
| CSP | LSTEWSPCSV | 366 | 10 | 18 | 95 | 1384 |
| CSP | LSVSSFLF | 8 | 8 | 19 | 100 | 1385 |
| CSP | LSVSSFLFV | 8 | 9 | 19 | 100 | 1386 |
| CSP | NAGINLYNB | 42 | 10 | 18 | 95 | 1387 |
| CSP | NANANNAV | 335 | 8 | 16 | 84 | 1388 |
| CSP | NSSIGLIM | 421 | 8 | 19 | 100 | 1389 |
| CSP | NSSIGLIMV | 421 | 9 | 19 | 100 | 1390 |
| CSP | NSSIGLIMVL | 421 | 10 | 19 | 100 | 1391 |
| CSP | NTRVLNEL | 31 | 8 | 19 | 100 | 1392 |
| CSP | NTRVLNELNY | 31 | 10 | i9 | 100 | 1393 |
| CSP | PSDKHIEQY | 346 | 9 | 15 | 79 | 1394 |
| CSP | PSDKHIEQYL | 346 | 10 | 15 | 79 | 1395 |
| CSP | SSFLFVEAL | 11 | 9 | 19 | 100 | 1396 |
| CSP | SSFLFVEALF | 11 | 10 | 19 | 100 | 1397 |
| CSP | SSIGLIMV | 422 | 8 | 19 | 100 | 1398 |
| CSP | SSIGLIMVL | 422 | 9 | 19 | 100 | 1399 |
| CSP | SSIGLIMVLSF | 422 | 11 | 19 | 100 | 1400 |
| CSP | SSKIRVLNEL | 29 | 10 | 19 | 100 | 1401 |
| CSP | SSSNTRVL | 28 | 8 | 19 | 100 | 1402 |
| CSP | SSSNTRVLNEL | 28 | 11 | 19 | 100 | 1403 |
| CSP | SSVFNVVNSSI | 414 | 11 | 19 | 100 | 1404 |
| CSP | STEWSPCSV | 367 | 9 | 19 | 100 | 1405 |
| CSP | VSSFLFVEAL | 10 | 10 | 19 | 100 | 1406 |
| CSP | VSSFLFVEALF | 10 | 11 | 19 | 100 | 1407 |
| CSP | VKONGIQV | 375 | 9 | 19 | 100 | 1408 |
| CSP | VTCGNGIQVRI | 375 | 11 | 19 | 100 | 1409 |
| CSP | YSLKKNSRSL | 63 | 10 | 19 | 100 | 1410 |
| EXP | ATSVLAGL | 77 | 8 | 1 | 100 | 1411 |
| EXP | ATSVLAGLL | 77 | 9 | 1 | 100 | 1412 |
| EXP | GSGEPLIDV | 42 | 9 | 1 | 100 | 1413 |
| EXP | ISDMIKKEEEL | S4 | 11 | 1 | 100 | 1414 |
| EXP | KSKYKLATSV | 71 | 10 | 1 | 100 | 1415 |
| EXP | KSKYKLATSVL | 71 | 11 | 1 | 100 | 1416 |
| EXP | KTNKOTOSOV | 24 | 10 | 1 | 100 | 1417 |
| EXP | LAGLLGNV | 81 | 8 | 1 | 100 | 1418 |
| EXP | LAGLLGNVSTV | 81 | 11 | 1 | 100 | 1419 |
| EXP | LALFFIW | 9 | 8 | 1 | 100 | 1420 |
| EXP | LATSVLAGL | 76 | 9 | 1 | 100 | 1421 |
| EXP | LATSVLAGLL | 76 | 10 | 1 | 100 | 1422 |
| EXP | LSVFFLAL | 4 | 8 | 1 | 100 | 1423 |
| EXP | LSVFFLALF | 4 | 9 | 1 | 100 | 1424 |
| EXP | LSVFFLALFF | 4 | 10 | 1 | 100 | 1425 |
| EXP | LSVFFLALFFI | 4 | 11 | 1 | 100 | 1426 |
| EXP | NADPQVTAQDV | 134 | 11 | 1 | 100 | 1427 |
| EXP | NTEKGRHPF | 102 | 9 | 1 | 100 | 1428 |
| EXP | NTEKGRHPFKL | 102 | 11 | 1 | 100 | 1429 |
| EXP | STVLLGGV | 89 | 8 | 1 | 100 | 1430 |
| EXP | STVLLGGVGL | 89 | 10 | 1 | 100 | 1431 |
| EXP | STVLLOOVGLV | 89 | 11 | 1 | 100 | 1432 |
| EXP | TSVLAGLL | 78 | 8 | 1 | 100 | 1433 |
| EXP | TSVLAGLLGNV | 78 | 11 | 1 | 100 | 1434 |
| EXP | VSTVLLGGV | 88 | 9 | 1 | 100 | 1435 |
| EXP | VSTVLLGGVGL | 88 | 11 | 1 | 100 | 1436 |
| LSA | DSKEISII | 1689 | 8 | 1 | 100 | 1437 |
| LSA | ETLQEQQSDL | 1193 | 10 | 1 | 100 | 1438 |
| LSA | ETLQGQQSDL | 156 | 10 | 1 | 100 | 1439 |
| LSA | ETVNISDV | 1745 | 8 | 1 | 100 | 1440 |
| LSA | EIVNISDVNDF | 1745 | 11 | 1 | 100 | 1441 |
| LSA | GSSNSRNRI | 42 | 9 | 1 | 100 | 1442 |
| LSA | HTLETVNI | 1742 | 8 | 1 | 100 | 1443 |
| LSA | HTLETVNISDV | 1742 | 11 | 1 | 100 | 1444 |
| LSA | ISAEYDDSL | 1764 | 9 | 1 | 100 | 1445 |
| LSA | ISAEYDDSLI | 1764 | 10 | 1 | 100 | 1446 |
| LSA | ISDVNDFQI | 1749 | 9 | 1 | 100 | 1447 |
| LSA | ISFYFILV | 7 | 8 | 1 | 100 | 1448 |
| LSA | ISFYFILVNL | 7 | 10 | 1 | 100 | 1449 |

TABLE XIII-continued

| Malaria B58 Super Motif Peptides | | | | | | |
|---|---|---|---|---|---|---|
| Protein | Sequence | Position | No. of Amino Acids | Sequence Frequency | Conservancy (%) | Seq. Id |
| LSA | ISFYFILVNLL | 7 | 11 | 1 | 100 | 1450 |
| LSA | ISKYEDEI | 1757 | 8 | 1 | 100 | 1451 |
| LSA | ITKYFMKL | 1902 | 8 | 1 | 100 | 1452 |
| LSA | ITTNVEGRRDI | 1704 | 11 | 1 | 100 | 1453 |
| LSA | KADTKKNL | 1631 | 8 | 1 | 100 | 1454 |
| LSA | KSADIQNHTL | 1735 | 10 | 1 | 100 | 1455 |
| LSA | KSLLRNLGV | 98 | 9 | 1 | 100 | 1456 |
| LSA | KSLYDEHI | 1854 | 8 | 1 | 100 | 1457 |
| LSA | KSLYDEHIKKY | 1854 | 11 | 1 | 100 | 1458 |
| LSA | KSSEELSEEKI | 1825 | 11 | 1 | 100 | 1459 |
| LSA | KTKNNENNKF | 68 | 10 | 1 | 100 | 1460 |
| LSA | KTKNNENNKFF | 68 | 11 | 1 | 100 | 1461 |
| LSA | KTNRESITTNV | 1698 | 11 | 1 | 100 | 1462 |
| LSA | LAEDLYGRL | 1648 | 9 | 1 | 100 | 1463 |
| LSA | LAEDLYGRLEI | 1648 | 11 | 1 | 100 | 1464 |
| LSA | LSEDTIKY | 1898 | 8 | 1 | 100 | 1465 |
| LSA | LSED1TKYF | 1898 | 9 | 1 | 100 | 1466 |
| LSA | LSEDITKYFM | 1898 | 10 | 1 | 100 | 1467 |
| LSA | LTNISNVKNV | 84 | 9 | 1 | 100 | 1468 |
| LSA | NSEKDEII | 28 | 8 | 1 | 100 | 1469 |
| LSA | NSRDSKEI | 1686 | 8 | 1 | 100 | 1470 |
| LSA | NSRDSKEISI | 1686 | 10 | 1 | 100 | 1471 |
| LSA | NSRDSKEISII | 1686 | 11 | 1 | 100 | 1472 |
| LSA | PSENERGY | 1664 | 8 | 1 | 100 | 1473 |
| LSA | PSENERGYY | 1664 | 9 | 1 | 100 | 1474 |
| LSA | PSENERGYYI | 1664 | 10 | 1 | 100 | 1475 |
| LSA | QSDLEQDRL | 1386 | 9 | 1 | 100 | 1476 |
| LSA | QSDLEQERL | 1590 | 9 | 1 | 100 | 1477 |
| LSA | QSDSEQERL | 519 | 9 | 1 | 100 | 1478 |
| LSA | QTNFKSLL | 94 | 8 | 1 | 100 | 1479 |
| LSA | QTNFKSLLRNL | 94 | 11 | 1 | 100 | 1480 |
| LSA | RSGSSNSRNRI | 40 | 11 | 1 | 100 | 1481 |
| LSA | RTKASKETL | 1187 | 9 | 1 | 100 | 1482 |
| LSA | SADIQNHTL | 1736 | 9 | 1 | 100 | 1483 |
| LSA | SAEYDDSL | 1765 | 8 | 1 | 100 | 1484 |
| LSA | SAEYDDSLI | 1765 | 9 | 1 | 100 | 1485 |
| LSA | SSEELSEEKI | 1826 | 10 | 1 | 100 | 1486 |
| LSA | SSNSRNRI | 43 | 8 | 1 | 100 | 1487 |
| LSA | TINVEGRRDI | 1705 | 10 | 1 | 100 | 1488 |
| LSA | VSQTNFKSL | 92 | 9 | 1 | 100 | 1489 |
| LSA | VSQINFKSLL | 92 | 10 | 1 | 100 | 1490 |
| SSP2 | ASCGVWDEW | 242 | 9 | 10 | 100 | 1491 |
| SSP2 | ASKNKEKAL | 107 | 9 | 10 | 100 | 1492 |
| SSP2 | ASKNKEKALI | 107 | 10 | 9 | 90 | 1493 |
| SSP2 | ASKNKEKALII | 107 | 11 | 9 | 90 | 1494 |
| SSP2 | ATPYAGEPAPF | 526 | 11 | 8 | 80 | 1495 |
| SSP2 | CAGLAYKF | 513 | 8 | 10 | 100 | 1496 |
| SSP2 | CAGLAYKFV | 513 | 9 | 10 | 100 | 1497 |
| SSP2 | CAGLAYKFVV | 513 | 10 | 10 | 100 | 1498 |
| SSP2 | CSGSIRRHNW | 55 | 10 | 10 | 100 | 1499 |
| SSP2 | CSGSIRRHNWV | 55 | 11 | 10 | 100 | 1500 |
| SSP2 | DALLQVRKHL | 135 | 10 | 9 | 90 | 1501 |
| SSP2 | DASKNKEKAL | 106 | 10 | 10 | 100 | 1502 |
| SSP2 | DASKNKEKALI | 106 | 11 | 9 | 90 | 1503 |
| SSP2 | DSAWENVKNV | 217 | 10 | 10 | 100 | 1504 |
| SSP2 | DSAWENVKNVI | 217 | 11 | 10 | 100 | 1505 |
| SSP2 | DSEKEVPSDV | 370 | 10 | 10 | 100 | 1506 |
| SSP2 | DSLKESRKL | 170 | 9 | 9 | 90 | 1507 |
| SSP2 | ETLGEEDKDL | 538 | 10 | 10 | 100 | 1508 |
| SSP2 | GSIRRHNW | 57 | 8 | 10 | 100 | 1509 |
| SSP2 | GSIRRHNWV | 57 | 9 | 10 | 100 | 1510 |
| SSP2 | GTRSRKREI | 260 | 9 | 10 | 100 | 1511 |
| SSP2 | GTRSRKRE3L | 260 | 10 | 10 | 100 | 1512 |
| SSP2 | HAVPLAMKL | 67 | 9 | 10 | 100 | 1513 |
| SSP2 | HAVPLAMKLI | 67 | 10 | 10 | 100 | 1514 |
| SSP2 | IAGGIAGGL | 500 | 9 | 10 | 100 | 1515 |
| SSP2 | IAGGIAGGLAL | 500 | 11 | 10 | 100 | 1516 |
| SSP2 | IAGGLALL | 504 | 8 | 10 | 100 | 1517 |
| SSP2 | IAVFGIGQGI | 185 | 10 | 10 | 100 | 1518 |
| SSP2 | KTASCGVW | 240 | 8 | 10 | 100 | 1519 |
| SSP2 | KTASCGVWDEW | 240 | 11 | 10 | 100 | 1520 |
| SSP2 | LACAGLAY | 511 | 8 | 10 | 100 | 1521 |
| SSP2 | LACAGLAYKF | 511 | 10 | 10 | 100 | 1522 |
| SSP2 | LACAGLAYKFV | 511 | 11 | 10 | 100 | 1523 |
| SSP2 | LALLACAGL | 508 | 9 | 10 | 100 | 1524 |

TABLE XIII-continued

Malaria B58 Super Motif Peptides

| Protein | Sequence | Position | No. of Amino Acids | Sequence Frequency | Conservancy (%) | Seq. Id |
|---|---|---|---|---|---|---|
| SSP2 | LALLACAGLAY | 508 | 11 | 10 | 100 | 1525 |
| SSP2 | LAMKLIQQL | 71 | 9 | 10 | 100 | 1526 |
| SSP2 | LAMKLIQQLNL | 71 | 11 | 10 | 100 | 1527 |
| SSP2 | LTDGIPDSI | 160 | 9 | 10 | 100 | 1528 |
| SSP2 | NANQLVVI | 152 | 8 | 10 | 100 | 1529 |
| SSP2 | NANQLVVIL | 152 | 9 | 10 | 100 | 1530 |
| SSP2 | PAPFDETL | 533 | 8 | 10 | 100 | 1531 |
| SSP2 | PSCOKCNL | 207 | 8 | 10 | 100 | 1532 |
| SSP2 | PSDGKCNLY | 207 | 9 | 10 | 100 | 1533 |
| SSP2 | QSQDNNGNRHV | 436 | 11 | 10 | 100 | 1534 |
| SSP2 | RSRKREIL | 262 | 8 | 10 | 100 | 1535 |
| SSP2 | SAWENVKNV | 218 | 9 | 10 | 100 | 1536 |
| SSP2 | SAWENVKNVI | 218 | 10 | 10 | 100 | 1537 |
| SSP2 | STNLPYGRTNL | 123 | 11 | 8 | 80 | 1538 |
| SSP2 | TASCGVWDEW | 241 | 10 | 10 | 100 | 1539 |
| SSP2 | VAFNRFLV | 196 | 8 | 10 | 100 | 1540 |
| SSP2 | YADSAWENV | 215 | 9 | 10 | 100 | 1541 |
| SSP2 | YAGEPAPF | 529 | 8 | 8 | 80 | 1542 |

TABLE XIV

Malaria B62 Super Motif Peptides

| Protein | Sequence | Position | No. of Amino Acids | Sequence Frequency | Conservancy (%) | Seq. Id. |
|---|---|---|---|---|---|---|
| CSP | AILSVSSF | 6 | 8 | 9 | 100 | 1543 |
| CSP | AILSVSSFLF | 6 | 10 | 9 | 100 | 1544 |
| CSP | AILSVSSFLFV | 6 | 11 | 9 | 100 | 1545 |
| CSP | ALFQEYQCY | 18 | 9 | 9 | 100 | 1546 |
| CSP | DIEKKKKM | 402 | 9 | 9 | 100 | 1547 |
| CSP | DPNANPNV | 130 | 8 | 9 | 100 | 1548 |
| CSP | ELNYDNAGI | 37 | 9 | 8 | 95 | 1549 |
| CSP | ENINYYGKQENW | 52 | 11 | 9 | 100 | 1550 |
| CSP | EPSDKHIEQY | 345 | 10 | 5 | 79 | 1551 |
| CSP | FLFVEALF | 13 | 8 | 9 | 100 | 1552 |
| CSP | FLFVEALFQEY | 13 | 11 | 9 | 100 | 1553 |
| CSP | FVEALFQEY | IS | 9 | 9 | 100 | 1554 |
| CSP | GINLYNELEM | 44 | 10 | 8 | 95 | 1555 |
| CSP | GLIMVLSF | 425 | 8 | 9 | 100 | 1556 |
| CSP | GLIMVLSFLF | 425 | 10 | 9 | 100 | 1557 |
| CSP | HIEQYLKKI | 350 | 9 | 5 | 79 | 1558 |
| CSP | ILSVSSFLF | 7 | 9 | 9 | 100 | 1559 |
| CSP | ILSVSSFLFV | 7 | 10 | 9 | 100 | 1560 |
| CSP | IMVLSFLF | 427 | 8 | 9 | 100 | 1561 |
| CSP | IQNSLSTEW | 362 | 9 | 5 | 79 | 1562 |
| CSP | KKKMEKCSSV | 406 | 11 | 9 | 100 | 1563 |
| CSP | KIQNSLSTEW | 361 | 10 | 5 | 79 | 1564 |
| CSP | KLAILSVSSF | 4 | 10 | 9 | 100 | 1565 |
| CSP | KMEKCSSV | 409 | 8 | 9 | 100 | 1566 |
| CSP | KMEXCSSVF | 409 | 9 | 9 | 100 | 1567 |
| CSP | KMEKCSSVFNV | 409 | 11 | 9 | 100 | 1568 |
| CSP | LIMVLSFLF | 426 | 9 | 9 | 100 | 1569 |
| CSP | MMRKLAILSV | 1 | 10 | 9 | 100 | 1570 |
| CSP | MPNDPNRNV | 324 | 9 | 9 | 100 | 1571 |
| CSP | NLYNELEM | 46 | 8 | 9 | 100 | 1572 |
| CSP | NLYNELEMNY | 46 | 10 | 9 | 100 | 1573 |
| CSP | NLYNELEMNYY | 46 | 11 | 9 | 100 | 1574 |
| CSP | NMPNDPNRNV | 323 | 10 | 9 | 100 | 1575 |
| CSP | NPDPNANPNV | 120 | 10 | 9 | 100 | 1576 |
| CSP | NQGNGQGHNM | 315 | 10 | 9 | 100 | 1577 |
| CSP | NVDPNANPNV | 128 | 10 | 9 | 100 | 1578 |
| CSP | NVVNSSIGLI | 418 | 10 | 9 | 100 | 1579 |
| CSP | NVVNSSIGLIM | 418 | 11 | 9 | 100 | 1580 |
| CSP | RVLNELNY | 33 | 8 | 9 | 100 | 1581 |
| CSP | SIGLIMVLSF | 423 | 10 | 9 | 100 | 1582 |
| CSP | SLSTEWSPCSV | 365 | 11 | 8 | 95 | 1583 |
| CSP | SPCSVTCGNGI | 371 | 11 | 9 | 100 | 1584 |
| CSP | SVFNVVNSSI | 415 | 10 | 9 | 100 | 1585 |
| CSP | SVSSFLFV | 9 | 8 | 9 | 100 | 1586 |
| CSP | SVTCGNGI | 374 | 8 | 9 | 100 | 1587 |
| CSP | SVTCGNGIQV | 374 | 10 | 9 | 100 | 1588 |

TABLE XIV-continued

Malaria B62 Super Motif Peptides

| Protein | Sequence | Position | No. of Amino Acids | Sequence Frequency | Conservancy (%) | Seq. Id. |
|---|---|---|---|---|---|---|
| CSP | VVNSSIGLI | 419 | 9 | 9 | 100 | 1589 |
| CSP | VVNSSIGLIM | 419 | 10 | 9 | 100 | 1590 |
| CSP | VVNSSIGLIMV | 419 | 11 | 9 | 100 | 1591 |
| EXP | DMIKKEEELV | 56 | 10 | 1 | 100 | 1592 |
| EXP | DPQVTAQDV | 136 | 9 | 1 | 100 | 1593 |
| EXP | DVHDLISDM | 49 | 9 | 1 | 100 | 1594 |
| EXP | DVHDLISDMI | 49 | 10 | 1 | 100 | 1595 |
| EXP | EPLIDVHDLI | 45 | 10 | 1 | 100 | 1596 |
| EXP | EPNADPQV | 132 | 8 | 1 | 100 | 1597 |
| EXP | EQPQGDDNNLV | 147 | 11 | 1 | 100 | 1598 |
| EXP | EVNKRKSKY | 66 | 9 | 1 | 100 | 1599 |
| EXP | FLALFFII | 8 | 8 | 1 | 100 | 1600 |
| EXP | FLALFFIIF | 8 | 9 | 1 | 100 | 1601 |
| EXP | GLLGNVSTV | 83 | 9 | 1 | 100 | 1602 |
| EXP | ILSVFFLALF | 3 | 10 | 1 | 100 | 1603 |
| EXP | ILSVFFLALFF | 3 | 11 | 1 | 100 | 1604 |
| EXP | KILSVFFLALF | 2 | 11 | 1 | 100 | 1605 |
| EXP | LIDVHDLI | 47 | 8 | 1 | 100 | 1606 |
| EXP | LIDVHDLISDM | 47 | 11 | 1 | 100 | 1607 |
| EXP | LLGGVGLV | 92 | 8 | 1 | 100 | 1608 |
| EXP | LLGGVGLVLY | 92 | 10 | 1 | 100 | 1609 |
| EXP | LLGNVSTV | 84 | 8 | 1 | 100 | 1610 |
| EXP | LVEVNKRKSKY | 64 | 11 | 1 | 100 | 1611 |
| EXP | MIKKEEELV | 57 | 9 | 1 | 100 | 1612 |
| EXP | MIKKEEELVEV | 57 | 11 | 1 | 100 | 1613 |
| EXP | NVSTVLLGGV | 87 | 10 | 1 | 100 | 1614 |
| EXP | PLIDVHDLI | 46 | 9 | 1 | 100 | 1615 |
| EXP | PQGDDNNLV | 149 | 9 | 1 | 100 | 1616 |
| EXP | PQVTAQDV | 137 | 8 | 1 | 100 | 1617 |
| EXP | QPQGDDNNLV | 148 | 10 | 1 | 100 | 1618 |
| EXP | SVFFLALF | 5 | 8 | 1 | 100 | 1619 |
| EXP | SVFFLALFF | 5 | 9 | 1 | 100 | 1620 |
| EXP | SVFFLALFFI | 5 | 10 | 1 | 100 | 1621 |
| EXP | SVFFLALFFII | 5 | 11 | 1 | 100 | 1622 |
| EXP | SVLAGLLGNV | 79 | 10 | 1 | 100 | 1623 |
| EXP | TVLLGGVCILV | 90 | 10 | 1 | 100 | 1624 |
| EXP | VLAGLLGNV | 80 | 9 | 1 | 100 | 1625 |
| EXP | VLLGGVGLV | 91 | 9 | 1 | 100 | 1626 |
| EXP | VLLGGVGLVLY | 91 | 11 | 1 | 100 | 1627 |
| LSA | DIQNHTLETV | 1738 | 10 | 1 | 100 | 1628 |
| LSA | DLDEFKPI | 1781 | 8 | 1 | 100 | 1629 |
| LSA | DLDEFKPIV | 1781 | 9 | 1 | 100 | 1630 |
| LSA | DLDEFKPIVQY | 1781 | 11 | 1 | 100 | 1631 |
| LSA | DLYGRLEI | 1651 | 8 | 1 | 100 | 1632 |
| LSA | DLYGRLEIPAI | 1651 | 11 | 1 | 100 | 1633 |
| LSA | DVLAEDLY | 1646 | 8 | 1 | 100 | 1634 |
| LSA | DVNDFQISKY | 1751 | 10 | 1 | 100 | 1635 |
| LSA | EISAEYDDSLI | 1763 | 11 | 1 | 100 | 1636 |
| LSA | ELPSENERGY | 1662 | 10 | 1 | 100 | 1637 |
| LSA | ELPSENERGYY | 1662 | 11 | 1 | 100 | 1638 |
| LSA | ELSEDITKY | 1897 | 9 | 1 | 100 | 1639 |
| LSA | ELSEDITKYF | 1897 | 10 | 1 | 100 | 1640 |
| LSA | ELSEDITKYFM | 1897 | 11 | 1 | 100 | 1641 |
| LSA | ELTMSNVKNV | 83 | 10 | 1 | 100 | 1642 |
| LSA | EQKEDKSADI | 1730 | 10 | 1 | 100 | 1643 |
| LSA | FIKSLFHI | 1877 | 8 | 1 | 100 | 1644 |
| LSA | FIKSLFHIF | 1877 | 9 | 1 | 100 | 1645 |
| LSA | FILVNLLI | 11 | 8 | 1 | 100 | 1646 |
| LSA | FILVNLLIF | 11 | 9 | 1 | 100 | 1647 |
| LSA | FILVNLLIFHI | 11 | 11 | 1 | 100 | 1648 |
| LSA | FQDEENIGI | 1794 | 9 | 1 | 100 | 1649 |
| LSA | FQDEENIGIY | 1794 | 10 | 1 | 100 | 1650 |
| LSA | FQISKYEDEI | 1755 | 10 | 1 | 100 | 1651 |
| LSA | GIYKELEDLI | 1801 | 10 | 1 | 100 | 1652 |
| LSA | HIFDODNEI | 1883 | 9 | 1 | 100 | 1653 |
| LSA | HIKKYKNDKQV | 1860 | 11 | 1 | 100 | 1654 |
| LSA | HILYISFY | 3 | 8 | 1 | 100 | 1655 |
| LSA | HILYISFYF | 3 | 9 | 1 | 100 | 1656 |
| LSA | HILYISFYFI | 3 | 10 | 1 | 100 | 1657 |
| LSA | HLEEKKDOSI | 1718 | 10 | 1 | 100 | 1658 |
| LSA | HVLSHNSY | 59 | 8 | 1 | 100 | 1659 |
| LSA | IIEKTNRESI | 1695 | 10 | 1 | 100 | 1660 |
| LSA | IIKNSEKDEI | 25 | 10 | 1 | 100 | 1661 |
| LSA | IIKNSEKDEII | 25 | 11 | 1 | 100 | 1662 |
| LSA | IINDDDDKKKY | 127 | 11 | 1 | 100 | 1663 |

TABLE XIV-continued

Malaria B62 Super Motif Peptides

| Protein | Sequence | Position | No. of Amino Acids | Sequence Frequency | Conservancy (%) | Seq. Id. |
|---|---|---|---|---|---|---|
| LSA | ILVNLLIF | 12 | 8 | 1 | 100 | 1664 |
| LSA | ILVNLLIFHI | 12 | 10 | 1 | 100 | 1665 |
| LSA | ILYISFYF | 4 | 8 | 1 | 100 | 1666 |
| LSA | ILYISFYFI | 4 | 9 | 1 | 100 | 1667 |
| LSA | ILYISFYFILV | 4 | 11 | 1 | 100 | 1668 |
| LSA | IQNHTLETV | 1739 | 9 | 1 | 100 | 1669 |
| LSA | IQNHTLETVNI | 1739 | 11 | 1 | 100 | 1670 |
| LSA | IVDELSEDI | 1894 | 9 | 1 | 100 | 1671 |
| LSA | KLIKNSEKDEI | 24 | 11 | 1 | 100 | 1672 |
| LSA | KIKKGKKY | 1834 | 8 | 1 | 100 | 1673 |
| LSA | KLNKEGKLI | 116 | 9 | 1 | 100 | 1674 |
| LSA | KPIVQYDNF | 1786 | 9 | 1 | 100 | 1675 |
| LSA | KPNDKSLY | 1850 | 8 | 1 | 100 | 1676 |
| LSA | KQVNKEKEKF | 1868 | 10 | 1 | 100 | 1677 |
| LSA | KQVNKEKEKFI | 1868 | 11 | 1 | 100 | 1678 |
| LSA | LIFHINGKI | 17 | 9 | 1 | 100 | 1679 |
| LSA | LIFHINGKII | 17 | 10 | 1 | 100 | 1680 |
| LSA | LLIFHINGKI | 16 | 10 | 1 | 100 | 1681 |
| LSA | LLIFHINGKII | 16 | 11 | 1 | 100 | 1682 |
| LSA | LLRNLGVSENI | 100 | 11 | 1 | 100 | 1683 |
| LSA | LPSENERGY | 1663 | 9 | 1 | 100 | 1684 |
| LSA | LPSENERGYY | 1663 | 10 | 1 | 100 | 1685 |
| LSA | LPSENERGYYI | 1663 | 11 | 1 | 100 | 1686 |
| LSA | LQIVDELSEDI | 1892 | 11 | 1 | 100 | 1687 |
| LSA | LVNLLIFHI | 13 | 9 | 1 | 100 | 1688 |
| LSA | NISDVNDF | 1748 | 8 | 1 | 100 | 1689 |
| LSA | NISDVNDFQI | 1748 | 10 | 1 | 100 | 1690 |
| LSA | NLDDLDEGI | 1815 | 9 | 1 | 100 | 1691 |
| LSA | NLERKKEHGDV | 1637 | 11 | 1 | 100 | 1692 |
| LSA | NLGVSENI | 103 | 8 | 1 | 100 | 1693 |
| LSA | NLGVSENIF | 103 | 9 | 1 | 100 | 1694 |
| LSA | NLLIFHINGKI | 15 | 11 | 1 | 100 | 1695 |
| LSA | NVEGRRDI | 707 | 8 | 1 | 100 | 1696 |
| LSA | NVKNVSQTNF | 88 | 10 | 1 | 100 | 1697 |
| LSA | PIVQYDNF | 787 | 8 | 1 | 100 | 1698 |
| LSA | QISKYEDEI | 756 | 9 | 1 | 100 | 1699 |
| LSA | QIVDELSEDI | 893 | 10 | 1 | 100 | 1700 |
| LSA | QVNKEKEKF | 869 | 9 | 1 | 100 | 1701 |
| LSA | QVNKEKEKFI | 869 | 10 | 1 | 100 | 1702 |
| LSA | SIIEKTNRESI | 694 | 11 | 1 | 100 | 1703 |
| LSA | SLLRNLGV | 99 | 8 | 1 | 100 | 1704 |
| LSA | SLYDEHIKKY | 855 | 10 | 1 | 100 | 1705 |
| LSA | TLETVMSDV | 743 | 10 | 1 | 100 | 1706 |
| LSA | TMSNVKNV | 85 | 8 | 1 | 100 | 1707 |
| LSA | TVNISDVNDF | 746 | 10 | 1 | 100 | 1708 |
| LSA | YISFYFILV | 6 | 9 | 1 | 100 | 1709 |
| SSP2 | ALLACAGLAY | 509 | 10 | 10 | 100 | 1710 |
| SSP2 | AVFGIGQGI | 186 | 9 | 10 | 100 | 1711 |
| SSP2 | AVFGIGQGINV | 186 | 11 | 10 | 100 | 1712 |
| SSP2 | AVPLAMKLI | 68 | 9 | 10 | 100 | 1713 |
| SSP2 | DLDEPEQF | 546 | 8 | 10 | 100 | 1714 |
| SSP2 | DLFLVNGRDV | 19 | 10 | 10 | 100 | 1715 |
| SSP2 | DQPRPRGDNF | 302 | 10 | 9 | 90 | 1716 |
| SSP2 | DVQNNIVDEI | 27 | 10 | 10 | 100 | 1717 |
| SSP2 | EIKYREEV | 35 | 8 | 9 | 90 | 1718 |
| SSP2 | EQFRLPEENEW | 551 | 11 | 10 | 100 | 1719 |
| SSP2 | EVCNDEVDLY | 41 | 10 | 8 | 80 | 1720 |
| SSP2 | EVDLYLLM | 46 | 8 | 8 | 80 | 1721 |
| SSP2 | EVEKTASCGV | 237 | 10 | 10 | 100 | 1722 |
| SSP2 | EVEKTASCGVW | 237 | 11 | 10 | 100 | 1723 |
| SSP2 | FLIFFDLF | 14 | 8 | 10 | 100 | 1724 |
| SSP2 | FLIFFDLFLV | 14 | 10 | 10 | 100 | 1725 |
| SSP2 | FLVNGRDV | 21 | 8 | 10 | 100 | 1726 |
| SSP2 | FMKAVCVEV | 230 | 9 | 10 | 100 | 1727 |
| SSP2 | FVVPGAATPY | 520 | 10 | 8 | 80 | 1728 |
| SSP2 | GIGQGNV | 189 | 8 | 10 | 100 | 1729 |
| SSP2 | GIGQGINVAF | 189 | 10 | 10 | 100 | 1730 |
| SSP2 | GINVAFNRF | 193 | 9 | 10 | 100 | 1731 |
| SSP2 | GINVAFNRFLV | 193 | 11 | 10 | 100 | 1732 |
| SSP2 | GLAYKFVV | 515 | 8 | 10 | 100 | 1733 |
| SSP2 | GPFMKAVCV | 228 | 9 | 10 | 100 | 1734 |
| SSP2 | GPFMKAVCVEV | 228 | 11 | 10 | 100 | 1735 |
| SSP2 | GQGINVAF | 191 | 8 | 10 | 100 | 1736 |
| SSP2 | GQGINVAFNRF | 191 | 11 | 10 | 100 | 1737 |
| SSP2 | GVKIAVFGI | 182 | 9 | 10 | 100 | 1738 |

TABLE XIV-continued

Malaria B62 Super Motif Peptides

| Protein | Sequence | Position | No. of Amino Acids | Sequence Frequency | Conservancy (%) | Seq. Id. |
|---|---|---|---|---|---|---|
| SSP2 | GVWDEWSPCSV | 245 | 11 | 10 | 100 | 1739 |
| SSP2 | HLGNVKYLV | 3 | 9 | 10 | 100 | 1740 |
| SSP2 | HLGNVKYLVI | 3 | 10 | 10 | 100 | 1741 |
| SSP2 | HLGNVKYLVIV | 3 | 11 | 10 | 100 | 1742 |
| SSP2 | HPSDGKCNLY | 206 | 10 | 10 | 100 | 1743 |
| SSP2 | ILTDGIPDS1 | 159 | 10 | 10 | 100 | 1744 |
| SSP2 | IPEDSEKEV | 367 | 9 | 10 | 100 | 1745 |
| SSP2 | IVDEIKYREEV | 32 | 11 | 9 | 90 | 1746 |
| SSP2 | IVFLIFFDLF | 12 | 10 | 10 | 100 | 1747 |
| SSP2 | KIAVFGIGQGI | 184 | 11 | 10 | 100 | 1748 |
| SSP2 | LEFFDLFLV | 15 | 9 | 10 | 100 | 1749 |
| SSP2 | LLACAGLAY | 510 | 9 | 10 | 100 | 1750 |
| SSP2 | LLACAGLAYKF | 510 | 11 | 10 | 100 | 1751 |
| SSP2 | LLMDCSGSI | 51 | 9 | 10 | 100 | 1752 |
| SSP2 | LLSTNLPY | 121 | 8 | 9 | 90 | 1753 |
| SSP2 | LMDCSGS1 | 52 | 8 | 10 | 100 | 1754 |
| SSP2 | LQVRKHLNDRI | 138 | 11 | 9 | 90 | 1755 |
| SSP2 | LVIVFLIF | 10 | 8 | to | 100 | 1756 |
| SSP2 | LVIVFLIFF | 10 | 9 | 10 | 100 | 1757 |
| SSP2 | LVNGRDVQNNI | 22 | 11 | 10 | 100 | 1758 |
| SSP2 | LVVILTDGI | 156 | 9 | 10 | 100 | 1759 |
| SSP2 | NIPEDSEKEV | 366 | 10 | 10 | 100 | 1760 |
| SSP2 | NIVDEIKY | 31 | 8 | 10 | 100 | 1761 |
| SSP2 | NLYADSAW | 213 | 8 | 10 | 100 | 1762 |
| SSP2 | NLYADSAWENV | 213 | 11 | 10 | 100 | 1763 |
| SSP2 | NPEDDRENF | 382 | 10 | 10 | 100 | 1764 |
| SSP2 | NQLVVILTDGI | 154 | 11 | 10 | 100 | 1765 |
| SSP2 | NVAFNRFLV | 195 | 9 | 10 | 100 | 1766 |
| SSP2 | NVIGPFMKAV | 225 | 10 | 10 | 100 | 1767 |
| SSP2 | NVKNVIGPF | 222 | 9 | 10 | 100 | 1768 |
| SSP2 | NVKNVIGPFM | 222 | 10 | 10 | 100 | 1769 |
| SSP2 | NVKYLVIV | 6 | 8 | 10 | 100 | 1770 |
| SSP2 | NVKYLVIVF | 6 | 9 | 10 | 100 | 1771 |
| SSP2 | NVKYLVIVFLI | 6 | 11 | 10 | 100 | 1772 |
| SSP2 | QLVVILTDG1 | 155 | 10 | 10 | 100 | 1773 |
| SSP2 | QPRPRGDNF | 303 | 9 | 9 | 90 | 1774 |
| SSP2 | QPRPRGDNFAV | 303 | 11 | 9 | 90 | 1775 |
| SSP2 | QVRKHLNDRI | 139 | 10 | 9 | 90 | 1776 |
| SSP2 | RINRENANQLV | 147 | 11 | 10 | 100 | 1777 |
| SSP2 | RLPEENEW | 554 | 8 | 10 | 100 | 1778 |
| SSP2 | RPRGDNFAV | 305 | 9 | 9 | 90 | 1779 |
| SSP2 | SIRRHNWV | 58 | 8 | 10 | 100 | 1780 |
| SSP2 | SLLSTNLPY | 120 | 9 | 9 | 90 | 1781 |
| SSP2 | SQDNNGNRHV | 437 | 10 | 10 | 100 | 1782 |
| SSP2 | TPYAGEPAPF | 527 | 10 | 8 | 80 | 1783 |
| SSP2 | VIGPFMKAV | 226 | 9 | 10 | 100 | 1784 |
| SSP2 | VIGPFMKAVCV | 226 | 11 | 10 | 100 | 1785 |
| SSP2 | VILTDGIPDSI | 158 | 11 | 10 | 100 | 1786 |
| SSP2 | VIVFLIFF | 11 | 8 | 10 | 100 | 1787 |
| SSP2 | VIVFLIFFDLF | 11 | 11 | 10 | 100 | 1788 |
| SSP2 | VPGAATPY | 522 | 8 | 8 | 80 | 1789 |
| SSP2 | VPLAMKLI | 69 | 8 | 10 | 100 | 1790 |
| SSP2 | VQNNIVDEI | 28 | 9 | 10 | 100 | 1791 |
| SSP2 | VQNNIVDEIKY | 28 | 11 | 10 | 100 | 1792 |
| SSP2 | VVILTDGI | 157 | 8 | 10 | 100 | 1793 |
| SSP2 | VVPGAATPY | 521 | 9 | 8 | 80 | 1794 |
| SSP2 | WVNHAVPLAM | 64 | 10 | 8 | 80 | 1795 |
| SSP2 | YLLMDCSGSI | 50 | 10 | 10 | 100 | 1796 |
| SSP2 | YLIVFLI | 9 | 8 | 10 | 100 | 1797 |
| SSP2 | YLIVFLIF | 9 | 9 | 10 | 100 | 1798 |
| SSP2 | YLIVFLFF | 9 | 10 | 10 | 100 | 1799 |

TABLE XV

Malaria A01 Motif Peptides With Binding Information

| Protein | Sequence | Position | No. of Amino Acids | Sequence Freq. | Conservancy (%) | A*0101 | Seq. Id. |
|---|---|---|---|---|---|---|---|
| CSP | DNAGINLY | 41 | 8 | 19 | 100 | | 1800 |
| CSP | EPSDKHIEQY | 345 | 10 | 15 | 79 | | 1801 |

TABLE XV-continued

Malaria A01 Motif Peptides With Binding Information

| Protein | Sequence | Position | No. of Amino Acids | Sequence Freq. | Conservancy (%) | A*0101 | Seq. Id. |
|---|---|---|---|---|---|---|---|
| CSP | FVEALFQEY | 15 | 9 | 19 | 100 | 3.4000 | 1802 |
| CSP | NTRYLNELNY | 31 | 10 | 19 | 100 | 0.0096 | 1803 |
| CSP | NYDNAGINLY | 39 | 10 | 18 | 95 | 0.0012 | 1804 |
| CSP | PSDKHIEQY | 346 | 9 | 15 | 79 | | 1805 |
| CSP | VEALFQEY | 16 | 8 | 19 | 100 | | 1806 |
| CSP | VEALFQEYQCY | 16 | 11 | 19 | 100 | | 1807 |
| CSP | YNELEMNY | 48 | 8 | 19 | 100 | | 1808 |
| CSP | YNELEMNYY | 48 | 9 | 19 | 100 | | 1809 |
| EXP | LVEVNKRKSKY | 64 | 11 | 1 | 100 | | 1810 |
| LSA | DDDDKKKY | 130 | 8 | 1 | 100 | | 1811 |
| LSA | DEENIGIY | 1796 | 8 | 1 | 100 | | 1812 |
| LSA | DLDEFKPIVQY | 1781 | 11 | 1 | 100 | | 1813 |
| LSA | EDEISAEY | 1761 | 8 | 1 | 100 | | 1814 |
| LSA | ELSEDITKY | 1897 | 9 | 1 | 100 | | 1815 |
| LSA | FQDEENIGIY | 1794 | 10 | 1 | 100 | 1.1000 | 1816 |
| LSA | HGDVLAEDLY | 1644 | 10 | 1 | 100 | 0.0012 | 1817 |
| LSA | INDDDDKKKY | 128 | 10 | 1 | 100 | | 1818 |
| LSA | KSLYDEHIKKY | 1854 | 11 | 1 | 100 | | 1819 |
| LSA | KYEDEISAEY | 1759 | 10 | 1 | 100 | 0.0011 | 1820 |
| LSA | LDEFKPIVQY | 1782 | 10 | 1 | 100 | | 1821 |
| LSA | LPSENERGY | 1663 | 9 | 1 | 100 | 0.6700 | 1822 |
| LSA | LPSENERGYY | 1663 | 10 | 1 | 100 | 0.0011 | 1823 |
| LSA | LSEDITKY | 1898 | 8 | 1 | 100 | | 1824 |
| LSA | LYDEHIKKY | 1856 | 9 | 1 | 100 | 0.0011 | 1825 |
| LSA | NDDDDKKKY | 129 | 9 | 1 | 100 | | 1826 |
| LSA | PSENERGY | 1664 | 8 | 1 | 100 | | 1827 |
| LSA | PSENERGYY | 1664 | 9 | 1 | 100 | 0.0790 | 1828 |
| LSA | QDEENIGIY | 1795 | 9 | 1 | 100 | | 1829 |
| LSA | SEEKIKKGKKY | 1831 | 11 | 1 | 100 | | 1830 |
| LSA | VDELSEDITKY | 1895 | 11 | 1 | 100 | | 1831 |
| LSA | VNDFQISKY | 1752 | 9 | 1 | 100 | | 1832 |
| LSA | YDEHIKKY | 1857 | 8 | 1 | 100 | | 1833 |
| LSA | YEDEISAEY | 1760 | 9 | 1 | 100 | 0.0012 | 1834 |
| SSP2 | CNDEVDLY | 43 | 8 | 8 | 80 | | 1835 |
| SSP2 | HPSDGKCNLY | 206 | 10 | 10 | 100 | 0.0260 | 1836 |
| SSP2 | LLACAGLAY | 510 | 9 | 10 | 100 | | 1837 |
| SSP2 | LLSTNLPY | 121 | 8 | 9 | 90 | | 1838 |
| SSP2 | PSDGKCNLY | 207 | 9 | 10 | 100 | 0.5400 | 1839 |

TABLE XVI

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| CSP | AILSVSSF | 6 | 8 | 19 | 100 | | 1840 |
| CSP | AILSVSSFLF | 6 | 10 | 19 | 100 | | 1841 |
| CS! | ALFQEYQCY | 18 | 9 | 19 | 100 | 0.0027 | 1842 |
| CSP | CGNGIQVR | 377 | 8 | 19 | 100 | | 1843 |
| CSP | CONGIQVRIK | 377 | 10 | 19 | 100 | 0.0005 | 1844 |
| CSP | DONNEDNEK | 96 | 9 | 19 | 100 | 0.0001 | 1845 |
| CSP | DGNNEDNEKLR | 96 | 11 | 19 | 100 | | 1846 |
| CSP | DGNNNNGDNGR | 77 | 11 | 17 | 89 | | 1847 |
| CSP | DGNPDPNA | 118 | 8 | 19 | 100 | | 1848 |
| CSP | D1EKKKK | 402 | 8 | 19 | 100 | | 1849 |
| CSP | D1EKKKKMEK | 402 | 11 | 19 | 100 | | 1850 |
| CSP | EALFQEYQCY | 17 | 10 | 19 | 100 | 0.0005 | 1851 |
| CSP | EDNEKLRK | 100 | 8 | 19 | 100 | | 1852 |
| CSP | EDNEKLRKPK | 100 | 10 | 19 | 100 | 0.0005 | 1853 |
| CSP | EDNEKLRKPKH | 100 | 11 | 19 | 100 | | 1854 |
| CSP | EGKDEDKR | 88 | 8 | 19 | 100 | | 1855 |
| CSP | ELBANYYOK | 50 | 9 | 19 | 100 | 0.0001 | 1856 |
| CSP | FLFVEALF | 13 | 8 | 19 | 100 | | 1857 |
| CSP | FLFVEALFQEY | 13 | 11 | 19 | 100 | | 1858 |
| CSP | FVEALFQEY | 15 | 9 | 19 | 100 | 0.0001 | 1859 |
| CSP | GDGNPDPNA | 117 | 9 | 19 | 100 | | 1860 |
| CSP | GDNGREOK | 83 | 8 | 19 | 100 | | 1861 |
| CSP | GIQVRIKPGSA | 380 | 11 | 19 | 100 | | 1862 |
| CSP | GLIMVLSF | 425 | 8 | 19 | 100 | | 1863 |
| CSP | GLIMVLSFLF | 425 | 10 | 19 | 100 | | 1864 |
| CSP | HIEQYLKK | 350 | 8 | 15 | 79 | | 1865 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| CSP | KKMEKCSSVF | 407 | 11 | 19 | 100 | | 1866 |
| CSP | IGLIMVLSF | 424 | 9 | 19 | 100 | | 1867 |
| CSP | IGLIMVLSFLF | 424 | 11 | 19 | 100 | | 1868 |
| CSP | ILSVSSFLF | 7 | 9 | 19 | 100 | | 1869 |
| CSP | IMVLSFLF | 427 | 8 | 19 | 100 | | 1870 |
| CSP | KLAILSVSSF | 4 | 10 | 19 | 100 | | 1871 |
| CSP | KLRKPKHK | 104 | 8 | 19 | 100 | | 1872 |
| CSP | KLAKANKK | 104 | 9 | 19 | 100 | 0.1300 | 1873 |
| CSP | KLRKPKEIKKLK | 104 | 11 | 19 | 100 | | 1874 |
| CSP | KMEKCSSVF | 409 | 9 | 19 | 100 | | 1875 |
| CSP | LAILSVSSF | 5 | 9 | 19 | 100 | | 1876 |
| CSP | LAILSVSSFLF | 5 | 11 | 19 | 100 | | 1877 |
| CSP | LDYENDIEK | 397 | 9 | 18 | 95 | 0.0002 | 1878 |
| CSP | LDYENDIEKK | 397 | 10 | 18 | 95 | 0.0005 | 1879 |
| CSP | LFQEYQCY | 19 | 8 | 19 | 100 | | 1880 |
| CSP | LFVEALFQEY | 14 | 10 | 19 | 100 | | 1881 |
| CSP | LIMVLSFLF | 426 | 9 | 19 | 100 | | 1882 |
| CSP | LSVSSFLF | 8 | 8 | 19 | 100 | | 1883 |
| CSP | LSVSSFLFVEA | 8 | 11 | 19 | 100 | | 1884 |
| CSP | NANANNAVK | 335 | 9 | 16 | 84 | 0.0001 | 1885 |
| CSP | NANPNANPNA | 300 | 10 | 19 | 100 | | 1886 |
| CSP | NANPNANPNK | 304 | 10 | 19 | 100 | 0.0005 | 1887 |
| CSP | NANPNVDPNA | 196 | 10 | 19 | 100 | | 1888 |
| CSP | NDIEKKICK | 401 | 9 | 19 | 100 | 0.0001 | 1889 |
| CSP | NDPNRNVDENA | 326 | 11 | 19 | 100 | | 1890 |
| CSP | NGDNGREGK | 82 | 9 | 19 | 100 | 0.0001 | 1891 |
| CSP | NGIQVRIK | 379 | 8 | 19 | 100 | | 1892 |
| CSP | NGREGKDEDK | 85 | 10 | 19 | 100 | 0.0005 | 1893 |
| CSP | NGREGKDEDKR | 85 | 11 | 19 | 100 | | 1894 |
| CSP | NLYNELEMNY | 46 | 10 | 19 | 100 | 0.0005 | 1895 |
| CSP | NLYNELEMNYY | 46 | 11 | 19 | 100 | | 1896 |
| CSP | NMPNDPNR | 323 | 8 | 19 | 100 | | 1897 |
| CSP | NTRVLNELNY | 31 | 10 | 19 | 100 | 0.0005 | 1898 |
| CSP | NVDENANA | 331 | 8 | 19 | 100 | | 1899 |
| CSP | NVDENANANNA | 331 | 11 | 16 | 84 | | 1900 |
| CSP | NVDPNANPNA | 200 | 10 | 19 | 100 | | 1901 |
| CSP | PGDGNPDPNA | 116 | 10 | 19 | 100 | | 1902 |
| CSP | PSDKHIEQY | 346 | 9 | 15 | 79 | | 1903 |
| CSP | PSDKHIEQYLK | 346 | 11 | 15 | 79 | | 1904 |
| CSP | QCYGSSSNTR | 24 | 10 | 19 | 100 | | 1905 |
| CSP | QGHNMPNDPNR | 320 | 11 | 19 | 100 | | 1906 |
| CSP | QVRIKPGSA | 382 | 9 | 19 | 100 | | 1907 |
| CSP | RDONNEDNEK | 95 | 10 | 19 | 100 | 0.0005 | 1908 |
| CSP | RVLNEI-NY | 33 | 8 | 19 | 100 | | 1909 |
| CSP | RVLNELNYDNA | 33 | 11 | 19 | 100 | | 1910 |
| CSP | SDKHIEQY | 347 | 8 | 15 | 79 | | 1911 |
| CSP | SDKHIEQYLK | 347 | 10 | 15 | 79 | | 1912 |
| CSP | SDKHIEQYLKK | 347 | 11 | 15 | 79 | | 1913 |
| CSP | SFLFVEALF | 12 | 9 | 19 | 100 | | 1914 |
| CSP | StGLIMVLSF | 423 | 10 | 19 | 100 | | 1915 |
| CSP | SSFLFVEA | 11 | 8 | 19 | 100 | | 1916 |
| CSP | SSFLFVEALF | 11 | 10 | 19 | 100 | | 1917 |
| CSP | SSIGLIMVLSF | 422 | 11 | 19 | 100 | | 1918 |
| CSP | SVSSFLFVEA | 9 | 10 | 19 | 100 | | 1919 |
| CSP | SYPCGNGIQVR | 374 | 11 | 19 | 100 | | 1920 |
| CSP | TCGNGIQVR | 376 | 9 | 19 | 100 | | 1921 |
| CSP | TCGNGIQVRIK | 376 | 11 | 19 | 100 | | 1922 |
| CSP | VDENANANNA | 332 | 10 | 16 | 84 | | 1923 |
| CSP | VDPNANPNA | 201 | 9 | 19 | 100 | | 1924 |
| CSP | VLNELNYDNA | 34 | 10 | 19 | 100 | | 1925 |
| CSP | VSSFLFVEA | 10 | 9 | 19 | 100 | | 1926 |
| CSP | VSSFLFVEALF | 10 | 11 | 19 | 100 | | 1927 |
| CSP | VTCGNGIQVR | 375 | 10 | 19 | 100 | 0.0005 | 1928 |
| CSP | YDNAGINLY | 40 | 9 | 18 | 95 | | 1929 |
| CSP | YGKQENWY | 56 | 8 | 19 | 100 | | 1930 |
| CSP | YGKQENWYSLK | 56 | 11 | 19 | 100 | | 1931 |
| CSP | YGSSSNTR | 26 | 8 | 19 | 100 | | 1932 |
| CSP | YSLKKNSR | 63 | 8 | 19 | 100 | | 1933 |
| EXP | ADNANPDA | 118 | 8 | 1 | 100 | | 1934 |
| EXP | ADSESNGEPNA | 125 | 11 | 1 | 100 | | 1935 |
| EXP | ALFFIFNK | 10 | 9 | 1 | 100 | 1.1000 | 1936 |
| EXP | DDNNLVSGPEH | 152 | 11 | 1 | 100 | | 1937 |
| EXP | DLISDMIK | 52 | 8 | 1 | 100 | | 1938 |
| EXP | DLISDMIKK | 52 | 9 | 1 | 100 | 0.0001 | 1939 |
| EXP | DSESNGEPNA | 126 | 10 | 1 | 100 | | 1940 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| EXP | DVHDLISDMIK | 49 | 11 | 1 | 100 | | 1941 |
| EXP | ELVEVNKR | 63 | 8 | 1 | 100 | | 1942 |
| EXP | ELVEVNKRK | 63 | 9 | 1 | 100 | 0.0001 | 1943 |
| EXP | ELVEVNKRKSK | 63 | 11 | 1 | 100 | | 1944 |
| EXP | ESLAEKTNK | 19 | 9 | 1 | 100 | 0.0001 | 1945 |
| EXP | ESNGEPNA | 128 | 8 | 1 | 100 | | 1946 |
| EXP | EVNKRKSK | 66 | 8 | 1 | 100 | | 1947 |
| EXP | EVNKRKSKY | 66 | 9 | 1 | 100 | 0.0001 | 1948 |
| EXP | EVNKRKSKYK | 66 | 10 | 1 | 100 | 0.0005 | 1949 |
| EXP | FFIIFNKESLA | 12 | 11 | 1 | 100 | | 1950 |
| EXP | FFLALFFIIF | 7 | 10 | 1 | 100 | | 1951 |
| EXP | FIIFNKESLA | 13 | 10 | 1 | 100 | | 1952 |
| EXP | FLALFFIIF | 8 | 9 | 1 | 100 | | 1953 |
| EXP | FLALFFIIFNK | 8 | 11 | 1 | 100 | | 1954 |
| EXP | GGVGLVLY | 94 | 8 | 1 | 100 | | 1955 |
| EXP | GLVLYNTEK | 97 | 9 | 1 | 100 | 0.0069 | 1956 |
| EXP | GLVLYNTEKGR | 97 | 11 | 1 | 100 | | 1957 |
| EXP | GSGEPLIDVH | 42 | 10 | 1 | 100 | 0.0005 | 1958 |
| EXP | GSGVSSKK | 30 | 8 | 1 | 100 | | 1959 |
| EXP | GSGVSSKKK | 30 | 9 | 1 | 100 | 0.0003 | 1960 |
| EXP | GSGVSSKKKNK | 30 | 11 | 1 | 100 | | 1961 |
| EXP | GSSDPADNA | 113 | 9 | 1 | 100 | | 1962 |
| EXP | GTGSGVSSK | 28 | 9 | 1 | 100 | 0.0039 | 1963 |
| EXP | GTGSGVSSKK | 28 | 10 | 1 | 100 | 0.0071 | 1964 |
| EXP | GTGSGVSSKKK | 28 | 11 | 1 | 100 | | 1965 |
| EXP | GVGLVLYNTEK | 95 | 11 | 1 | 100 | | 1966 |
| EXP | GVSSKKKNK | 32 | 9 | 1 | 100 | 0.0001 | 1967 |
| EXP | GVSSKKKNKK | 32 | 10 | 1 | 100 | 0.0011 | 1968 |
| EXP | HDLISDMIK | 51 | 9 | 1 | 100 | 0.0001 | 1969 |
| EXP | HDLISDMIKK | 51 | 10 | 1 | 100 | 0.0009 | 1970 |
| EXP | IFNKESLA | 15 | 8 | 1 | 100 | | 1971 |
| EXP | IFNKESLAEK | 15 | 10 | 1 | 100 | 0.0005 | 1972 |
| EXP | IGSSDPADNA | 112 | 10 | 1 | 100 | | 1973 |
| EXP | IIFNKESLA | 14 | 9 | 1 | 100 | | 1974 |
| EXP | IIFNKESLAEK | 14 | 11 | 1 | 100 | | 1975 |
| EXP | ILSVFFLA | 3 | 8 | 1 | 100 | | 1976 |
| EXP | ILSVFFLALF | 3 | 10 | 1 | 100. | | 1977 |
| EXP | ILSVFFLALFF | 3 | 11 | 1 | 100 | | 1978 |
| EXP | KGSGEPLIDVH | 41 | 11 | 1 | 100 | | 1979 |
| EXP | KGTGSGVSSK | 27 | 10 | 1 | 100 | 0.0005 | 1980 |
| EXP | KGTGSGVSSKK | 27 | 11 | 1 | 100 | | 1981 |
| EXP | KIGSSDPA | 111 | 8 | 1 | 100 | | 1982 |
| EXP | KlGSSDPADNA | 111 | 11 | 1 | 100 | | 1983 |
| EXP | K1LSVFFLA | 2 | 9 | 1 | 100 | 0.1400 | 1984 |
| EXP | KILSVFFLALF | 2 | 11 | 1 | 100 | | 1985 |
| EXP | KLATSVLA | 75 | 8 | 1 | 100 | | 1986 |
| EXP | LALFFIIF | 9 | 8 | 1 | 100 | | 1987 |
| EXP | LALFFIIFNK | 9 | 10 | 1 | 100 | 0.0140 | 1988 |
| EXP | LFFIIFNK | 11 | 8 | 1 | 100 | | 1989 |
| EXP | LGGVGLVLY | 93 | 9 | 1 | 100 | 0.0001 | 1990 |
| EXP | LISDMIKK | 53 | 8 | 1 | 100 | | 1991 |
| EXP | LLGGVGLVLY | 92 | 10 | 1 | 100 | 0.0034 | 1992 |
| EXP | LSVFFLALF | 4 | 9 | 1 | 100 | | 1993 |
| EXP | LSVFFLALFF | 4 | 10 | 1 | 100 | | 1994 |
| EXP | LVEVNKRK | 64 | 8 | 1 | 100 | | 1995 |
| EXP | LVEVNKRKSK | 64 | 10 | 1 | 100 | 0.0005 | 1996 |
| EXP | LVEVNKRKSKY | 64 | 11 | 1 | 100 | | 1997 |
| EXP | LVLYNIEK | 98 | 8 | 1 | 100 | | 1998 |
| EXP | LVLYNTEKGR | 98 | 10 | 1 | 100 | 0.0005 | 1999 |
| EXP | LVLYNTEKGRH | 99 | 11 | 1 | 100 | | 2000 |
| EXP | NADPQVTA | 134 | 8 | 1 | 100 | | 2001 |
| EXP | NLVSGPEH | 155 | 8 | 1 | 100 | | 2002 |
| EXP | NTEKGRHPF | 102 | 9 | 1 | 100 | | 2003 |
| EXP | NTEKGRHPFK | 102 | 10 | 1 | 100 | 0.0047 | 2004 |
| EXP | PADNANPDA | 117 | 9 | 1 | 100 | | 2005 |
| EXP | PFKIGSSDPA | 109 | 10 | 1 | 100 | | 2006 |
| EXP | SDPADNANPDA | 115 | 11 | 1 | 100 | | 2007 |
| EXP | SGEPLIDVH | 43 | 9 | 1 | 100 | 0.0001 | 2008 |
| EXP | SGVSSKKK | 31 | 8 | 1 | 100 | | 2009 |
| EXP | SGVSSKKKNK | 31 | 10 | 1 | 100 | 0.0005 | 2010 |
| EXP | SGVSSKKKNKK | 31 | 11 | 1 | 100 | | 2011 |
| EXP | SLAEKITIK | 20 | 8 | 1 | 100 | | 2012 |
| EXP | SSDPADNA | 114 | 8 | 1 | 100 | | 2013 |
| EXP | SSKKKNKK | 34 | 8 | 1 | 100 | | 2014 |
| EXP | SVFFLALF | 5 | 8 | 1 | 100 | | 2015 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| EXP | SVFFLALFF | 5 | 9 | 1 | 100 | | 2016 |
| EXP | TGSGVSSK | 29 | 8 | 1 | 100 | | 2017 |
| EXP | MSGVSSKK | 29 | 9 | 1 | 100 | 0.0001 | 2018 |
| EXP | TGSGVSSKKK | 29 | 10 | 1 | 100 | 0.0005 | 2019 |
| EXP | VFFLALFF | 6 | 8 | 1 | 100 | | 2020 |
| EXP | VFFLALFFIIF | 6 | 11 | 1 | 100 | | 2021 |
| EXP | VGLVLYNTEK | 96 | 10 | 1 | 100 | 0.0005 | 2022 |
| EXP | VLLGGVGLVLY | 91 | 11 | 1 | 100 | | 2023 |
| EXP | VLYNTEKGR | 99 | 9 | 1 | 100 | 0.0110 | 2024 |
| EXP | VLYNTEKGRH | 99 | 10 | 1 | 100 | 0.0029 | 2025 |
| EXP | VSSKKKNK | 33 | 8 | 1 | 100 | | 2026 |
| EXP | VSSKKKNKK | 33 | 9 | 1 | 100 | 0.0001 | 2027 |
| LSA | ADTKKNLER | 1632 | 9 | 1 | 100 | | 2028 |
| LSA | ADTKKNLERK | 1632 | 10 | 1 | 100 | 0.0001 | 2029 |
| LSA | ADTKKNLERKK | 1632 | 11 | 1 | 100 | | 2030 |
| LSA | AIELPSENER | 1660 | 10 | 1 | 100 | 0.0001 | 2031 |
| LSA | DDDDKKKY | 130 | 8 | 1 | 100 | | 2032 |
| LSA | DDDDKKKY1K | 130 | 10 | 1 | 100 | 0.0001 | 2033 |
| LSA | DDDKKKYIK | 131 | 9 | 1 | 100 | 0.0001 | 2034 |
| LSA | DDEDLDEF | 1778 | 8 | 1 | 100 | | 2035 |
| LSA | DDEDLDEFK | 1778 | 9 | 1 | 100 | 0.0001 | 2036 |
| LSA | DDKKKYIK | 132 | 8 | 1 | 100 | | 2037 |
| LSA | DDLDEG1EK | 1817 | 9 | 1 | 100 | 0.0001 | 2038 |
| LSA | DGSIKPEQK | 1724 | 9 | 1 | 100 | 0.0001 | 2039 |
| LSA | DIHKGHLEEK | 1713. | 10 | 1 | 100 | 0.0004 | 2040 |
| LSA | DIHKGHLEEKK | 1713 | 11 | 1 | 100 | | 2041 |
| LSA | DITKYFMK | 1901 | 8 | 1 | 100 | | 2042 |
| LSA | DLDEFKPIVQY | 1781 | 11 | 1 | 100 | | 2043 |
| LSA | DLDEGIEK | 1818 | 8 | 1 | 100 | | 2044 |
| LSA | DLEEKAAK | 148 | 8 | 1 | 100 | | 2045 |
| LSA | DLEQERLA | 1388 | 8 | 1 | 100 | | 2046 |
| LSA | DLEQDRLAK | 1388 | 9 | 1 | 100 | 0.0001 | 2047 |
| LSA | DLEQDRLAKEK | 1388 | 11 | 1 | 100 | | 2048 |
| LSA | DLEQERLA | 1609 | 8 | 1 | 100 | | 2049 |
| LSA | DLEQERLAK | 1609 | 9 | 1 | 100 | 0.0001 | 2050 |
| LSA | DLEQERLAKEK | 1609 | 11 | 1 | 100 | | 2051 |
| LSA | DLEQERLANEK | 1524 | 11 | 1 | 100 | | 2052 |
| LSA | DLEQERRA | 1575 | 8 | 1 | 100 | | 2053 |
| LSA | DLEQERRAK | 1575 | 9 | 1 | 100 | 0.0001 | 2054 |
| LSA | DLEQERRAKEK | 1575 | 11 | 1 | 100 | | 2055 |
| LSA | DLEQRKADTK | 1626 | 10 | 1 | 100 | 0.0001 | 2056 |
| LSA | DLEQRKADTKK | 1626 | 11 | 1 | 100 | | 2057 |
| LSA | DLERTKASK | 1184 | 9 | 1 | 100 | 0.0001 | 2058 |
| ISA | DLYGRLEIPA | 1651 | 10 | 1 | 100 | | 2059 |
| LSA | DSEQERLA | 521 | 8 | 1 | 100 | | 2060 |
| LSA | DSEQERLAK | 521 | 9 | 1 | 100 | 0.0001 | 2061 |
| LSA | DSEQERLAKEK | 521 | 11 | 1 | 100 | | 2062 |
| LSA | DSKEISIIEK | 1689 | 10 | 1 | 100 | 0.0001 | 2063 |
| LSA | DTKKNLER | 1633 | 8 | 1 | 100 | | 2064 |
| LSA | DTKKNLERK | 1633 | 9 | 1 | 100 | 0.0001 | 2065 |
| LSA | DTKKNLERKK | 1633 | 10 | 1 | 100 | 0.0001 | 2066 |
| LSA | DVLAEDLY | 1646 | 8 | 1 | 100 | | 2067 |
| LSA | DVLAEDLYGR | 1646 | 10 | 1 | 100 | 0.0001 | 2068 |
| LSA | DVNDFQISK | 1751 | 9 | 1 | 100 | 0.0001 | 2069 |
| LSA | DVNDFQISKY | 1751 | 10 | 1 | 100 | 0.0003 | 2070 |
| LSA | EDDEDLDEF | I777 | 9 | 1 | 100 | | 2071 |
| ISA | EDDEDLDEFK | 1777 | 10 | 1 | 100 | 0.0001 | 2072 |
| LSA | EDEISAEY | 1761 | 8 | 1 | 100 | | 2073 |
| LSA | EDITKYFMK | 1900 | 9 | 1 | 100 | 0.0001 | 2074 |
| LSA | EDKSADIQNH | I733 | 10 | 1 | 100 | | 2075 |
| LSA | EDLEEKAA | 147 | 8 | 1 | 100 | | 2076 |
| LSA | EDLEEKAAK | 147 | 9 | 1 | 100 | 0.0002 | 2077 |
| LSA | EDLYGRLEIPA | 1650 | 11 | 1 | 100 | | 2078 |
| ISA | EFKPIVQY | 1784 | 8 | 1 | 100 | | 2079 |
| LSA | EFKPIVQYDNF | 1784 | 11 | 1 | 100 | | 2080 |
| LSA | EGRRDIHK | 1709 | 8 | 1 | 100 | | 2081 |
| LSA | EGRRDIHKGH | 1709 | 10 | 1 | 100 | 0.0001 | 2082 |
| LSA | EIIKSNLR | 33 | 8 | 1 | 100 | | 2083 |
| LSA | EISIIEKTNR | 1692 | 10 | 1 | 100 | 0.0001 | 2084 |
| LSA | ELEDLIEK | 1805 | 8 | 1 | 100 | | 2085 |
| LSA | ELPSENER | 1662 | 8 | 1 | 100 | | 2086 |
| LSA | ELPSENERGY | 1662 | 10 | 1 | 100 | 0.0001 | 2087 |
| LSA | ELPSENERGYY | 1662 | 11 | 1 | 100 | | 2088 |
| LSA | ELSEDITK | 1897 | 8 | 1 | 100 | | 2089 |
| LSA | ELSEDITKY | 1897 | 9 | 1 | 100 | 0.0002 | 2090 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| LSA | ELSEDITKYF | 1897 | 10 | 1 | 100 | | 2091 |
| LSA | ELSEEKIK | 1829 | 8 | 1 | 100 | | 2092 |
| LSA | ELSEEKIKK | 1929 | 9 | 1 | 100 | 0.0002 | 2093 |
| LSA | ELSEEKIKKGK | 1829 | 11 | 1 | 100 | | 2094 |
| LSA | ELTMSNVK | 83 | 8 | 1 | 100 | | 2095 |
| LSA | ESITTNVEGR | 1702 | 10 | 1 | 100 | 0.0001 | 2096 |
| LSA | ESMNVEGRR | 1702 | 11 | 1 | 100 | | 2097 |
| LSA | ETVNISDVNDF | 1745 | 11 | 1 | 100 | | 2098 |
| LSA | FIKSLFHIF | 1877 | 9 | 1 | 100 | | 2099 |
| LSA | FILVNLLIF | 11 | 9 | 1 | 100 | | 2100 |
| LSA | FILVNLLIFH | 11 | 10 | 1 | 100 | 0.0310 | 2101 |
| LSA | FLKENKLNK | 111 | 9 | 1 | 100 | 0.0260 | 2102 |
| LSA | GDVLAEDLY | 1645 | 9 | 1 | 100 | | 2103 |
| LSA | GDVLAEDLYGR | 1645 | 11 | 1 | 100 | | 2104 |
| LSA | GSIKPEQK | 1725 | 8 | 1 | 100 | | 2105 |
| LSA | GSIKPEQKEDK | 1725 | 11 | 1 | 100 | | 2106 |
| LSA | GSSNSRNR | 42 | 8 | 1 | 100 | | 2107 |
| LSA | GVSENIFLK | 105 | 9 | 1 | 100 | 0.2700 | 2108 |
| LSA | HGDVLAEDLY | 1644 | 10 | 1 | 100 | 0.0001 | 2109 |
| LSA | HIINDDDDK | 126 | 9 | 1 | 100 | 0.0002 | 2110 |
| LSA | H11NDDIDDKK | 126 | 10 | 1 | 100 | 0.0001 | 2111 |
| LSA | HITNDDDDKKK | 126 | 11 | 1 | 100 | | 2112 |
| LSA | HIKKYKNDK | 1860 | 9 | 1 | 100 | 0.0002 | 2113 |
| LSA | HILYISFY | 3 | 8 | 1 | 100 | | 2114 |
| LSA | HILYISFYF | 3 | 9 | 1 | 100 | | 2115 |
| LSA | HINGKIIK | 20 | 8 | 1 | 100 | | 2116 |
| LSA | HLEEKKDGSIK | 1718 | 11 | 1 | 100 | | 2117 |
| LSA | HVLSHNSY | 59 | 8 | 1 | 100 | | 2118 |
| LSA | HVLSHNSYEK | 59 | 10 | 1 | 100 | 0.0170 | 2119 |
| LSA | IFHINGKIIK | 18 | 10 | 1 | 100 | 0.0001 | 2120 |
| LSA | IFLKENKLINK | 110 | 10 | 1 | 100 | 0.0001 | 2121 |
| LSA | IINDDDDK | 127 | 8 | 1 | 100 | | 2122 |
| LSA | IINDDDDKK | 127 | 9 | 1 | 100 | 0.0002 | 2123 |
| LSA | IINDDDDKKK | 127 | 10 | 1 | 100 | 0.0001 | 2124 |
| LSA | IINDDDDKKKY | 127 | 11 | 1 | 100 | | 2125 |
| LSA | ILVNLLIF | 12 | 8 | 1 | 100 | | 2126 |
| LSA | ILVNLLIFH | 12 | 9 | 1 | 100 | 0.0150 | 2127 |
| LSA | ILYISFYF | 4 | 8 | 1 | 100 | | 2128 |
| LSA | ISDVNDFQISK | 1749 | 11 | 1 | 100 | | 2129 |
| LSA | ISIIEKTNR | 1693 | 9 | 1 | 100 | 0.0001 | 2130 |
| LSA | ISKYEDEISA | 1757 | 10 | 1 | 100 | | 2131 |
| LSA | ITTNVEGR | 1704 | 8 | 1 | 100 | | 2132 |
| LSA | ITTNVEGRR | 1704 | 9 | 1 | 100 | 0.0002 | 2133 |
| LSA | IVDELSEDMC | 1894 | 11 | 1 | 100 | | 2134 |
| LSA | KADTKKNLER | 1631 | 10 | 1 | 100 | 0.0001 | 2135 |
| LSA | KADTKKNLERK | 631 | 11 | 1 | 100 | | 2136 |
| LSA | KDBIKSNLR | 31 | 10 | 1 | 100 | | 2137 |
| LSA | KDGSIKPEQK | 1723 | 10 | 1 | 100 | 0.0004 | 2138 |
| LSA | KDKELTMSNVK | 80 | 11 | 1 | 100 | | 2139 |
| LSA | KDNNFKPNDK | 1845 | 10 | 1 | 100 | 0.0001 | 2140 |
| LSA | KFIKSLFH | 1876 | 8 | 1 | 100 | | 2141 |
| LSA | KFIKSLFHIF | 1876 | 10 | 1 | 100 | | 2142 |
| LSA | KGHLEEKK | 1716 | 8 | 1 | 100 | | 2143 |
| LSA | KGKKYEKTK | 1837 | 9 | 1 | 100 | 0.0002 | 2144 |
| LSA | KIWNSEK | 24 | 8 | 1 | 100 | | 2145 |
| LSA | KIKKGKKY | 1834 | 8 | 1 | 100 | | 2146 |
| LSA | KIKKGKKYEK | 1834 | 10 | 1 | 100 | 0.0081 | 2147 |
| LSA | KLNKEGKLIEH | 116 | 11 | 1 | 100 | | 2148 |
| LSA | KLQEQQSDLER | 1177 | 11 | 1 | 100 | | 2149 |
| LSA | KSADIQNH | 1735 | 8 | 1 | 100 | | 2150 |
| LSA | KSLYDEHIK | 1854 | 9 | 1 | 100 | 0.0005 | 2151 |
| LSA | KSLYDEHIKK | 1854 | 10 | 1 | 100 | 0.0094 | 2152 |
| LSA | KSLYDEHIKKY | 1854 | 11 | 1 | 100 | | 2153 |
| LSA | KSSEELSEEK | 1825 | 10 | 1 | 100 | 0.0001 | 2154 |
| LSA | KTKDNNFK | 1843 | 8 | 1 | 100 | | 2155 |
| LSA | KIKNNENNK | 68 | 9 | 1 | 100 | 0.0028 | 2156 |
| LSA | KTKNNENNKF | 68 | 10 | 1 | 100 | | 2157 |
| LSA | KTKNNENNKFF | 68 | 11 | 1 | 100 | | 2158 |
| LSA | LAEDLYGR | 1648 | 8 | 1 | 100 | | 2159 |
| LSA | LAKEKLQEQQR | 1615 | 11 | 1 | 100 | | 2160 |
| LSA | LANEKLQEQQR | 1530 | 11 | 1 | 100 | | 2161 |
| LSA | LDDLDEGIEK | 1816 | 10 | 1 | 100 | 0.0001 | 2162 |
| LSA | LDEFKPIVQY | 1782 | 10 | 1 | 100 | | 2163 |
| LSA | LGVSENIF | 104 | 8 | 1 | 100 | | 2164 |
| LSA | LGVSENIFLK | 104 | 10 | 1 | 100 | 0.0001 | 2165 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| LSA | LIFHINGK | 17 | 8 | 1 | 100 | | 2166 |
| LSA | LIFHINGKIIK | 17 | 11 | 1 | 100 | | 2167 |
| LSA | LLIFHINGK | 16 | 9 | 1 | 100 | 0.0260 | 2168 |
| LSA | LSEDMCY | 1898 | 8 | 1 | 100 | | 2169 |
| LSA | LSEDITKYF | 1898 | 9 | 1 | 100 | | 2170 |
| LSA | LSEDITKYFMK | 1898 | 11 | 1 | 100 | | 2171 |
| LSA | LSEEKIKK | 1830 | 8 | 1 | 100 | | 2172 |
| LSA | LSEEKIKKGK | 1830 | 10 | 1 | 100 | 0.0004 | 2173 |
| LSA | LSEEKIKKGKK | 1830 | 11 | 1 | 100 | | 2174 |
| LSA | LSHNSYEK | 61 | 8 | 1 | 100 | | 2175 |
| LSA | LSHNSYEKTK | 61 | 10 | 1 | 100 | 0.0004 | 2176 |
| LSA | LVNLLIFH | 13 | 8 | 1 | 100 | | 2177 |
| LSA | NDDDQKKK | 129 | 8 | 1 | 100 | | 2178 |
| LSA | NDDDDKKKY | 129 | 9 | 1 | 100 | | 2179 |
| LSA | NDDDDKKKYIK | 129 | 11 | 1 | 100 | | 2180 |
| LSA | NDFQISKY | 1753 | 8 | 1 | 100 | | 2181 |
| LSA | NDKQVNKEK | 1866 | 9 | 1 | 100 | 0.0002 | 2182 |
| LSA | NDKQVNKEKEK | 1866 | 11 | 1 | 100 | | 2183 |
| LSA | NDKSLYDER | 1852 | 9 | 1 | 100 | | 2184 |
| LSA | NDKSLYDEHIK | 1852 | 11 | 1 | 100 | | 2185 |
| LSA | NFKPNDKSLY | 1848 | 10 | 1 | 100 | | 2186 |
| LSA | NFQDEENIGIY | 1793 | 11 | 1 | 100 | | 2187 |
| LSA | NGKIIKNSEK | 22 | 10 | 1 | 100 | 0.0004 | 2188 |
| LSA | NIFLKENK | 109 | 8 | 1 | 100 | | 2189 |
| LSA | NIFLKENKLNK | 109 | 11 | 1 | 100 | | 2190 |
| LSA | NISDVNDF | 1748 | 8 | 1 | 100 | | 2191 |
| LSA | NLDDLDEGIEK | 1815 | 11 | 1 | 100 | | 2192 |
| LSA | NLERKKEH | 1637 | 8 | 1 | 100 | | 2193 |
| LSA | NLGVSENIF | 103 | 9 | 1 | 100 | | 2194 |
| LSA | NILVSENIFLK | 103 | 11 | 1 | 100 | | 2195 |
| LSA | NLLIFHINGK | 15 | 10 | 1 | 100 | 0.0049 | 2196 |
| LSA | NLRSGSSNSR | 38 | 10 | 1 | 100 | 0.0004 | 2197 |
| LSA | NSEKDEIIK | 28 | 9 | 1 | 100 | 0.0002 | 2198 |
| LSA | NSRNRINEEK | 45 | 10 | 1 | 100 | 0.0004 | 2199 |
| LSA | NSRNRINEEKH | 45 | 11 | 1 | 100 | | 2200 |
| LSA | NVEGRRDIH | 1707 | 9 | 1 | 100 | 0.0002 | 2201 |
| LSA | NVEGRRDIHK | 1707 | 10 | 1 | 100 | 0.0004 | 2202 |
| LSA | NVKNVSQTNF | 88 | 10 | 1 | 100 | | 2203 |
| LSA | NVKNVSQTNFK | 88 | 11 | 1 | 100 | | 2204 |
| LSA | NVSQTNFK | 91 | 8 | 1 | 100 | | 2205 |
| LSA | PAIELPSENER | 1659 | 11 | 1 | 100 | | 2206 |
| LSA | PIVQYDNF | 1787 | 8 | 1 | 100 | | 2207 |
| LSA | PSENERGY | 1664 | 8 | 1 | 100 | | 2208 |
| LSA | PSENERGYY | 1664 | 9 | 1 | 100 | 0.0001 | 2209 |
| LSA | QDEENIGIY | 1795 | 9 | 1 | 100 | | 2210 |
| LSA | QDEENIGIYK | 1795 | 10 | 1 | 100 | 0.0004 | 2211 |
| LSA | QDNRGNSR | 1681 | 8 | 1 | 100 | | 2212 |
| LSA | QDNRGNSRDSK | 1681 | 11 | 1 | 100 | | 2213 |
| LSA | QDRLAKEK | 1391 | 8 | 1 | 100 | | 2214 |
| LSA | QGQQQSDLEQER | 1128 | 11 | 1 | 100 | | 2215 |
| LSA | QISKYEDEISA | 756 | 11 | 1 | 100 | | 2216 |
| LSA | QSDLEQDR | 386 | 8 | 1 | 100 | | 2217 |
| LSA | QSDLEQDRLA | 386 | 10 | 1 | 100 | | 2218 |
| LSA | QSDLEQDRLAK | 386 | 11 | 1 | 100 | | 2219 |
| LSA | QSDLEQDR | 590 | 8 | 1 | 100 | | 2220 |
| LSA | QSDLEQERLA | 590 | 10 | 1 | 100 | | 2221 |
| LSA | QSDLEQERLAK | 590 | 11 | 1 | 100 | | 2222 |
| LSA | QSDLEQERR | 573 | 9 | 1 | 100 | 0.0002 | 2223 |
| LSA | QSDLEQERRA | 573 | 10 | 1 | 100 | | 2224 |
| LSA | QSDLEQERRAK | 573 | 11 | 1 | 100 | | 2225 |
| LSA | QSDLERTK | 182 | 8 | 1 | 100 | | 2226 |
| LSA | QSDLERTKA | 182 | 9 | 1 | 100 | | 2227 |
| LSA | QSDLERTKASK | 182 | 11 | 1 | 100 | | 2228 |
| LSA | QSDSEQER | 519 | 8 | 1 | 100 | | 2229 |
| LSA | QSDSEQERLA | 519 | 10 | 1 | 100 | | 2230 |
| LSA | QSDSEQERLAK | 519 | 11 | 1 | 100 | | 2231 |
| LSA | QSSLPQDNR | 1676 | 9 | 1 | 100 | 0.0002 | 2232 |
| LSA | QTNFKSLLR | 94 | 9 | 1 | 100 | 0.0320 | 2233 |
| LSA | QVNKEKEK | 1869 | 8 | 1 | 100 | | 2234 |
| LSA | QVNKEKERF | 1869 | 9 | 1 | 100 | | 2235 |
| LSA | QVNKEKEKFIK | 1869 | 11 | 1 | 100 | | 2236 |
| LSA | RDIHKGHLEEK | 1712 | 11 | 1 | 100 | | 2237 |
| LSA | RDLEQERLA | 1608 | 9 | 1 | 100 | | 2238 |
| LSA | RDLEQERLAK | 1608 | 10 | 1 | 100 | 0.0004 | 2239 |
| LSA | RDLEQERR | 1540 | 8 | 1 | 100 | | 2240 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| LSA | RDLEQERRA | 1540 | 9 | 1 | 100 | | 2241 |
| LSA | RDLEQERRAK | 1540 | 10 | 1 | 100 | 0.0004 | 2242 |
| LSA | RDLEQRKA | 1625 | 8 | 1 | 100 | | 2243 |
| LSA | RDLEQRKADTK | 1625 | 11 | 1 | 100 | | 2244 |
| LSA | RDSKEISIIEK | 1688 | 11 | 1 | 100 | | 2245 |
| LSA | RGNSRDSK | 1684 | 8 | 1 | 100 | | 2246 |
| LSA | RINEEKHEK | 49 | 9 | 1 | 100 | 0.0033 | 2247 |
| LSA | RINEEKHEKK | 49 | 10 | 1 | 100 | 0.0024 | 2248 |
| LSA | RINEEKHEKKH | 49 | 11 | 1 | 100 | | 2249 |
| LSA | RSGSSNSR | 40 | 8 | 1 | 100 | | 2250 |
| LSA | RSGSSNSRNR | 40 | 10 | 1 | 100 | 0.0011 | 2251 |
| LSA | SDLEQDRLA | 1387 | 9 | 1 | 100 | | 2252 |
| LSA | SDLEQDRLAK | 1387 | 10 | 1 | 100 | 0.0002 | 2253 |
| LSA | SDLEQERLA | 1591 | 9 | 1 | 100 | | 2254 |
| LSA | SDLEQERLAK | 1591 | 10 | 1 | 100 | 0.0002 | 2255 |
| LSA | SDLEQERR | 1574 | 8 | 1 | 100 | | 2256 |
| LSA | SDLMERRA | 1574 | 9 | 1 | 100 | | 2257 |
| LSA | SDLEQERRAK | 1574 | 10 | 1 | 100 | 0.0002 | 2258 |
| LSA | SDLERTKA | 1183 | 8 | 1 | 100 | | 2259 |
| LSA | SDLERTKASK | 1183 | 10 | 1 | 100 | 0.0002 | 2260 |
| LSA | SDSEQERLA | 520 | 9 | 1 | 100 | | 2261 |
| LSA | SDSEQERLAK | 520 | 10 | 1 | 100 | 0.0002 | 2262 |
| LSA | SDVNDFQISK | 1750 | 10 | 1 | 100 | 0.0002 | 2263 |
| LSA | SDVNDFQISKY | 1750 | 11 | 1 | 100 | | 2264 |
| LSA | SGSSNSRNR | 41 | 9 | 1 | 100 | 0.0002 | 2265 |
| LSA | SIIEKTNR | 1694 | 8 | 1 | 100 | | 2266 |
| LSA | SIKPEQKEDK | 1726 | 10 | 1 | 100 | 0.0002 | 2267 |
| LSA | SITTNVEGR | 1703 | 9 | 1 | 100 | 0.0002 | 2268 |
| LSA | SITTNVEGRR | 1703 | 10 | 1 | 100 | 0.0002 | 2269 |
| LSA | SLPQDNRGNSR | 1678 | 11 | 1 | 100 | | 2270 |
| LSA | SLYDEHIK | 1855 | 8 | 1 | 100 | | 2271 |
| LSA | SLYDEHIKK | 1855 | 9 | 1 | 100 | 0.0460 | 2272 |
| LSA | SLYDDIIKKY | 1855 | 10 | 1 | 100 | 0.0015 | 2273 |
| LSA | SLYDEHIKKYK | 1855 | 11 | 1 | 100 | | 2274 |
| LSA | SSEELSEEK | 1826 | 9 | 1 | 100 | 0.0002 | 2275 |
| LSA | SSEELSEEK | 1826 | 11 | 1 | 100 | | 2276 |
| LSA | SSLPQDNR | 1677 | 8 | 1 | 100 | | 2277 |
| LSA | TTNVEGRR | 1705 | 8 | 1 | 100 | | 2278 |
| LSA | TTNVEGRPDIH | 1705 | 11 | 1 | 100 | | 2279 |
| LSA | TVNISDVNDF | 1746 | 10 | 1 | 100 | | 2280 |
| LSA | VDELSEDITK | 1895 | 10 | 1 | 100 | 0.0002 | 2281 |
| LSA | VDELSEDTIKY | 1895 | 11 | 1 | 100 | | 2282 |
| LSA | VLAEDLYGR | 1647 | 9 | 1 | 100 | 0.0013 | 2283 |
| LSA | VLSHNSYEK | 60 | 9 | 1 | 100 | 0.0280 | 2284 |
| LSA | VLSHNSYEKTK | 60 | 11 | 1 | 100 | | 2285 |
| LSA | VSENIFLK | 106 | 8 | 1 | 100 | | 2286 |
| LSA | VSENIFLKENK | 106 | 11 | 1 | 100 | | 2287 |
| LSA | VSQTNFKSLLR | 92 | 11 | 1 | 100 | | 2288 |
| LSA | YDEHIKKY | 1857 | 8 | 1 | 100 | | 2289 |
| LSA | YDEHIKKYK | 1857 | 9 | 1 | 100 | 0.0005 | 2290 |
| LSA | YFILVNLLIF | 10 | 10 | 1 | 100 | | 2291 |
| LSA | YFILVNLLFH | 10 | 11 | 1 | 100 | | 2292 |
| LSA | VGRLEIPA | 1653 | 8 | 1 | 100 | | 2293 |
| LSA | YIKGQDENR | 137 | 9 | 1 | 100 | 0.0025 | 2294 |
| SSP2 | AATPYAGEPA | 525 | 10 | 8 | 80 | | 2295 |
| SSP2 | ACAGLAYK | 512 | 8 | 10 | 100 | | 2296 |
| SSP2 | ACAGLAYKF | 512 | 9 | 10 | 100 | | 2297 |
| SSP2 | ADSAWENVK | 216 | 9 | 10 | 100 | 0.0002 | 2298 |
| SSP2 | AFNRFLVGCH | 197 | 10 | 10 | 100 | | 2299 |
| SSP2 | AGGLAGGLA | 501 | 9 | 10 | 100 | | 2300 |
| SSP2 | AGGLALLA | 505 | 8 | 10 | 100 | | 2301 |
| SSP2 | AGGLALLACA | 505 | 10 | 10 | 100 | | 2302 |
| SSP2 | ALLACAGLA | 509 | 9 | 10 | 100 | 0.0002 | 2303 |
| SSP2 | ALLACAGLAY | 509 | 10 | 10 | 100 | 0.0630 | 2304 |
| SSP2 | ALLACAGLAYK | 509 | 11 | 10 | 100 | | 2305 |
| SSP2 | ALLQVRKH | 136 | 8 | 9 | 90 | | 2306 |
| SSP2 | ASKNKEKA | 107 | 8 | 10 | 100 | | 2307 |
| SSP2 | ATPYAGEPA | 526 | 9 | 8 | 80 | | 2308 |
| SSP2 | ATPYAGEPAPF | 526 | 11 | 8 | 80 | | 2309 |
| SSP2 | AVCVEVEK | 233 | 8 | 10 | 100 | | 2310 |
| SSP2 | AVCVEVEKTA | 233 | 10 | 10 | 100 | | 2311 |
| SSP2 | CAGLAYKF | 513 | 8 | 10 | 100 | | 2312 |
| SSP2 | CGKGTRSR | 257 | 8 | 10 | 100 | | 2313 |
| SSP2 | CGKGTRSRK | 257 | 9 | 10 | 100 | 0.0002 | 2314 |
| SSP2 | CGKCIRSRKR | 257 | 10 | 10 | 100 | 0.0002 | 2315 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| SSP2 | CSGSIRRH | 55 | 8 | 10 | 100 | | 2316 |
| SSP2 | CSVTCGKGTR | 253 | 10 | 10 | 100 | 0.0002 | 2317 |
| SSP2 | CVEVEKTA | 235 | 8 | 10 | 100 | | 2318 |
| SSP2 | DALLQVRK | 135 | 8 | 9 | 90 | | 2319 |
| SSP2 | DALLQVRKH | 135 | 9 | 9 | 90 | 0.0004 | 2320 |
| SSP2 | DASKNKEK | 106 | 8 | 10 | 100 | | 2321 |
| SSP2 | DASKNKEKA | 106 | 9 | 10 | 100 | | 2322 |
| SSP2 | DCKSIRR | 54 | 8 | 10 | 100 | | 2323 |
| SSP2 | DCSGSIRRH | 54 | 9 | 10 | 100 | | 2324 |
| SSP2 | DDQPRPRGDNF | 301 | 11 | 9 | 90 | | 2325 |
| SSP2 | DDREENFDIPK | 385 | 11 | 10 | 100 | | 2326 |
| SSP2 | DGKCNLYA | 209 | 8 | 10 | 100 | | 2327 |
| SSP2 | DGKCNLYADSA | 209 | 11 | 10 | 100 | | 2328 |
| SSP2 | DIPKKPENK | 392 | 9 | 10 | 100 | 0.0004 | 2329 |
| SSP2 | DIPKKPENKE | 392 | 10 | 10 | 100 | 0.0002 | 2330 |
| SSP2 | DLDEPEQF | 546 | 8 | 10 | 100 | | 2331 |
| SSP2 | DLDEPEQFR | 546 | 9 | 10 | 100 | 0.0002 | 2332 |
| SSP2 | DLFLVNGR | 19 | 8 | 10 | 100 | | 2333 |
| SSP2 | DSAWENVK | 217 | 8 | 10 | 100 | | 2334 |
| SSP2 | DSIQDSLK | 166 | 8 | 10 | 100 | | 2335 |
| SSP2 | DSIQDSLKESR | 166 | 11 | 10 | 100 | | 2336 |
| SSP2 | DSLKESRK | 170 | 8 | 9 | 90 | | 2337 |
| SSP2 | DVPKNPEDDR | 378 | 10 | 10 | 100 | 0.0002 | 2338 |
| SSP2 | DVQNNIVDEIK | 27 | 11 | 10 | 100 | | 2339 |
| SSP2 | EDDQPRPR | 300 | 8 | 10 | 100 | | 2340 |
| SSP2 | EDDREENF | 384 | 8 | 10 | 100 | | 2341 |
| SSP2 | EDKDLDEPEQF | 543 | 11 | 10 | 100 | | 2342 |
| SSP2 | EDRETRPH | 450 | 8 | 9 | 90 | | 2343 |
| SSP2 | EDRETRPHGR | 450 | 10 | 9 | 90 | | 2344 |
| SSP2 | EIIRLHSDA | 99 | 9 | 10 | 100 | | 2345 |
| SSP2 | EIIRLHSDASK | 99 | 11 | 10 | 100 | | 2346 |
| SSP2 | ELQEQCEEER | 276 | 10 | 8 | 80 | 0.0002 | 2347 |
| SSP2 | ETLGEEDK | 538 | 8 | 10 | 100 | | 2348 |
| SSP2 | EVCNDEVDLY | 41 | 10 | 8 | 80 | 0.0002 | 2349 |
| SSP2 | EVPSDVPK | 374 | 8 | 10 | 100 | | 2350 |
| SSP2 | FDETLGEEDK | 536 | 10 | 10 | 100 | 0.0002 | 2351 |
| SSP2 | FDIPKKPENK | 391 | 10 | 10 | 100 | 0.0002 | 2352 |
| SSP2 | FDIPKKPENKH | 391 | 11 | 10 | 100 | | 2353 |
| SSP2 | FDLFLVNGR | 18 | 9 | 10 | 100 | | 2354 |
| SSP2 | FFDLFLVNGR | 17 | 10 | 10 | 100 | | 2355 |
| SSP2 | FGIGQGINVA | 188 | 10 | 10 | 100 | | 2356 |
| SSP2 | FGIGQGINVAF | 188 | 11 | 10 | 100 | | 2357 |
| SSP2 | FLIFFDLF | 14 | 8 | 10 | 100 | | 2358 |
| SSP2 | FLVGCHPSDGK | 201 | 11 | 10 | 100 | | 2359 |
| SSP2 | FMKAVCVEVEK | 230 | 11 | 10 | 100 | | 2360 |
| SSP2 | FVVPGAATPY | 520 | 10 | 8 | 80 | 0.0002 | 2361 |
| SSP2 | FVVPGAATPYA | 520 | 11 | 8 | 80 | | 2362 |
| SSP2 | GAATPYAGEPA | 524 | 11 | 8 | 80 | | 2363 |
| SSP2 | GCHPSDGK | 204 | 8 | 10 | 100 | | 2364 |
| SSP2 | GDNFAVEK | 308 | 8 | 9 | 90 | | 2365 |
| SSP2 | GGIAGGLA | 502 | 8 | 10 | 100 | | 2366 |
| SSP2 | GGIAGGLALLA | 502 | 11 | 10 | 100 | | 2367 |
| SSP2 | GGLALLACA | 506 | 9 | 10 | 100 | | 2368 |
| SSP2 | GIAGGLALLA | 503 | 10 | 10 | 100 | | 2369 |
| SSP2 | GIGQGINVA | 189 | 9 | 10 | 100 | | 2370 |
| SSP2 | GIGQGINVAF | 189 | 10 | 10 | 100 | | 2371 |
| SSP2 | GINVAFNR | 193 | 8 | 10 | 100 | | 2372 |
| SSP2 | GINVAFNRF | 193 | 9 | 10 | 100 | | 2373 |
| SSP2 | GIPDSIQDSLK | 163 | 11 | 10 | 100 | | 2374 |
| SSP2 | GLALLACA | 507 | 8 | 10 | 100 | | 2375 |
| SSP2 | GLALLACAGLA | 507 | 11 | 10 | 100 | | 2376 |
| SSP2 | GLAYKFVVPGA | 515 | 11 | 10 | 100 | | 2377 |
| SSP2 | GSIRRHNWVNH | 57 | 11 | 8 | 80 | | 2378 |
| SSP2 | GTRSRKIZEILH | 260 | 11 | 10 | 100 | | 2379 |
| SSP2 | HAVPLAMK | 67 | 8 | 10 | 100 | | 2380 |
| SSP2 | HDNQNNLPNDK | 401 | 11 | 10 | 100 | | 2381 |
| SSP2 | HGRNNENR | 457 | 8 | 10 | 100 | | 2382 |
| SSP2 | HGRNNENRSY | 457 | 10 | 10 | 100 | 00004 | 2383 |
| SSP2 | HLNDRINR | 143 | 8 | 10 | 100 | | 2384 |
| SSP2 | HLNDRINRENA | 143 | 11 | 10 | 100 | | 2385 |
| SSP2 | HSDASKNK | 104 | 8 | 10 | 100 | | 2386 |
| SSP2 | HSDASKNKEK | 104 | 10 | to | 100 | 0.0004 | 2387 |
| SSP2 | HSDASKNKEKA | 104 | 11 | 10 | 100 | | 2388 |
| SSP2 | HVPNSEDR | 445 | 8 | 10 | 100 | | 2389 |
| SSP2 | HVPNSEDRETR | 445 | 11 | 9 | 90 | | 2390 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| SSP2 | IAGGIAGGLA | 500 | 10 | 10 | 100 | | 2391 |
| SSP2 | IAGGLALLA | 504 | 9 | 10 | 100 | 0.0002 | 2392 |
| SSP2 | IAGGLALLACA | 504 | 11 | 10 | 100 | | 2393 |
| SSP2 | IFFDLFLVNGR | 16 | 11 | 10 | 100 | | 2394 |
| SSP2 | IGQGINVA | 190 | 8 | 10 | 100 | | 2395 |
| SSP2 | IGQGINVAF | 190 | 9 | 10 | 100 | | 2396 |
| SSP2 | IGQGINVAFNR | 190 | 11 | 10 | 100 | | 2397 |
| SSP2 | IIRLHSDA | 100 | 8 | 10 | 100 | | 2398 |
| SSP2 | IIRLHSDASK | 100 | 10 | 10 | 100 | 0.0230 | 2399 |
| SSP2 | IVDEIKYR | 32 | 8 | 9 | 90 | | 2400 |
| SSP2 | IVFLIFFDLF | 12 | 10 | 10 | 100 | | 2401 |
| SSP2 | KAVCVEVEK | 232 | 9 | 10 | 100 | 0.0004 | 2402 |
| SSP2 | KAVCVEVEKTA | 232 | 11 | 10 | 100 | | 2403 |
| SSP2 | KCNLYADSA | 211 | 9 | 10 | 100 | | 2404 |
| SSP2 | KDLDEPEQF | 545 | 9 | 10 | 100 | | 2405 |
| SSP2 | KDLDEPEQFR | 545 | 10 | 10 | 100 | | 2406 |
| SSP2 | KFVVPGAA | 519 | 8 | 10 | 100 | | 2407 |
| SSP2 | KFVVPGAATPY | 519 | 11 | 8 | 80 | . | 2408 |
| SSP2 | KGIRSRKR | 259 | 8 | 10 | 100 | | 2409 |
| SSP2 | KIAGGIAGGLA | 499 | 11 | 10 | 100 | | 2410 |
| SSP2 | KVLDNERK | 421 | 8 | 8 | 80 | | 2411 |
| SSP2 | LACACLAY | 511 | 8 | 10 | 100 | | 2412 |
| SSP2 | LACAGLAYK | 511 | 9 | 10 | 100 | 0.0240 | 2413 |
| SSP2 | LACAGLAYKF | 511 | 10 | 10 | 100 | | 2414 |
| SSP2 | LALLACAGLA | 508 | 10 | 10 | 100 | | 2415 |
| SSP2 | LALLACAGLAY | 508 | 11 | 10 | 100 | | 2416 |
| SSP2 | LAYKFVVPGA | 516 | 10 | 10 | 100 | | 2417 |
| SSP2 | LAYKFVVPGAA | 516 | 11 | 10 | 100 | | 2418 |
| SSP2 | LDEPEQFR | 547 | 8 | 10 | 100 | | 2419 |
| SSP2 | LGNVKYLVIVF | 4 | 11 | 10 | 100 | | 2420 |
| SSP2 | LLACAGLA | 510 | 8 | 10 | 100 | | 2421 |
| SSP2 | LLACAGLAY | 510 | 9 | 10 | 100 | 0.0120 | 2422 |
| SSP2 | LLACAGLAYK | 510 | 10 | 10 | 100 | 0.9500 | 2423 |
| SSP2 | LLACAGLAYKF | 510 | 11 | 10 | 100 | | 2424 |
| SSP2 | LLMDCSGSIR | 5I | 10 | 10 | 100 | 0.0004 | 2425 |
| SSP2 | LLMDCSGSIRR | 5I | 11 | 10 | 100 | | 2426 |
| SSP2 | LLQVRKHLNDR | 137 | 11 | 9 | 90 | | 2427 |
| SSP2 | LLSTNLPY | 121 | 8 | 9 | 90 | | 2428 |
| SSP2 | LLSTNLPYGR | 121 | 10 | 8 | 80 | 0.0017 | 2429 |
| SSP2 | LMDCSGSIR | 52 | 9 | 10 | 100 | 0.0004 | 2430 |
| SSP2 | LMDCSGSIRR | 52 | 10 | 10 | 100 | 0.0015 | 2431 |
| SSP2 | LMDCSGSIRRH | 52 | 11 | 10 | 100 | | 2432 |
| SSP2 | LSTNLPYGR | 122 | 9 | 8 | 80 | 0.0004 | 2433 |
| SSP2 | LVGCHPSDGK | 202 | 10 | 10 | 100 | 0.0004 | 2434 |
| SSP2 | LVIVFLIF | 10 | 8 | 10 | 100 | | 2435 |
| SSP2 | LVIVFLIFF | 10 | 9 | 10 | 100 | | 2436 |
| SSP2 | MDCSGSIR | 53 | 8 | 10 | 100 | | 2437 |
| SSP2 | MDCSGS1RR | 53 | 9 | 10 | 100 | | 2438 |
| SSP2 | MDCSGSIRRH | S3 | 10 | 10 | 100 | | 2439 |
| SSP2 | NDRINRENA | 145 | 9 | 10 | 100 | | 2440 |
| SSP2 | NFDIPKKPENK | 390 | 11 | 10 | 100 | | 2441 |
| SSP2 | NIPEDSEK | 366 | 8 | 10 | 100 | | 2442 |
| SSP2 | NIVDEIKY | 31 | 8 | 10 | 100 | | 2443 |
| SSP2 | NIVDEIKYR | 31 | 9 | 9 | 90 | 0.0005 | 2444 |
| SSP2 | NLPNDKSDR | 406 | 9 | 10 | 100 | 0.0005 | 2445 |
| SSP2 | NSEDRETR | 448 | 8 | 9 | 90 | | 2446 |
| SSP2 | NSEDRETRPH | 448 | 10 | 9 | 90 | 0.0004 | 2447 |
| SSP2 | NVIGPFMK | 225 | 8 | 10 | 100 | | 2448 |
| SSP2 | NVIGPFMKA | 225 | 9 | 10 | 100 | 0.0002 | 2449 |
| SSP2 | NVKNVIGPF | 222 | 9 | 10 | 100 | | 2450 |
| SSP2 | NVKNVIGPFMK | 222 | 11 | 10 | 100 | | 2451 |
| SSP2 | NVKYLVIVF | 6 | 9 | 10 | 100 | | 2452 |
| SSP2 | PCSVTCGK | 252 | 8 | 10 | 100 | | 2453 |
| SSP2 | PCSVTCGKGTR | 252 | 11 | 10 | 100 | | 2454 |
| SSP2 | PDSIQDSLK | 165 | 9 | 10 | 100 | 0.0005 | 2455 |
| SSP2 | PFDETLGEEDK | 535 | 11 | 10 | 100 | | 2456 |
| SSP2 | PGAATPYA | 523 | 8 | 8 | 80 | | 2457 |
| SSP2 | PSDGKCNLY | 207 | 9 | 10 | 100 | 0.0002 | 2458 |
| SSP2 | PSDGKCNLYA | 207 | 10 | 10 | 101 | | 2459 |
| SSP2 | PSPNPEEGK | 328 | 9 | 10 | 100 | 0.0005 | 2460 |
| SSP2 | QCEEERCPPK | 280 | 10 | 8 | 80 | 0.0004 | 2461 |
| SSP2 | QDNNGNRH | 438 | 8 | 10 | 100 | | 2462 |
| SSP2 | QDSLKESR | 169 | 8 | 10 | 100 | | 2463 |
| SSP2 | QDSLKESRK | 169 | 9 | 9 | 90 | 0.0005 | 2464 |
| SSP2 | QGINVAFNR | 192 | 9 | 10 | 100 | 0.0009 | 2465 |

TABLE XVI-continued

Malaria A3 Motif Peptides With Binding Information

| Protein | Sequence | Position | No. of Amino Acids | Sequence Frequency | Conservancy (%) | A*0301 | Seq. Id |
|---|---|---|---|---|---|---|---|
| SSP2 | QGINVAFNRF | 192 | 10 | 10 | 100 | | 2466 |
| SSP2 | QSQDNNGNR | 436 | 9 | 10 | 100 | 0.0005 | 2467 |
| SSP2 | QSQDNNGNRH | 436 | 10 | 10 | 100 | 0.0004 | 2468 |
| SSP2 | QVRKHLNDR | 139 | 9 | 9 | 90 | 0.0005 | 2469 |
| SSP2 | RGDNFAVEK | 307 | 9 | 9 | 90 | 0.0005 | 2470 |
| SSP2 | RGVKIAVF | 181 | 8 | 9 | 90 | | 2471 |
| SSP2 | RLHSDASK | 102 | 8 | 10 | 100 | | 2472 |
| SSP2 | RLHSDASKNK | 102 | 10 | 10 | 100 | 0.0240 | 2473 |
| SSP2 | RSRKREILH | 262 | 9 | 10 | 100 | 0.0110 | 2474 |
| SSP2 | SDASKNKEK | 105 | 9 | 10 | 100 | 0.0005 | 2475 |
| SSP2 | SDASKNKEKA | 105 | 10 | 10 | 100 | | 2476 |
| SSP2 | SDGKCNLY | 208 | 8 | 10 | 100 | | 2477 |
| SSP2 | SDGKCNLYA | 208 | 9 | 10 | 100 | | 2478 |
| SSP2 | SDNKYKIA | 494 | 8 | 9 | 90 | | 2479 |
| SSP2 | SDVPKNPEDDR | 377 | 11 | 10 | 100 | | 2480 |
| SSP2 | SIQDSLKESR | 167 | 10 | 10 | 100 | 0.0004 | 2481 |
| SSP2 | SIQDSLKESRK | 167 | 11 | 9 | 90 | | 2482 |
| SSP2 | SIRRHNWVNH | 58 | 10 | 8 | 80 | 0.0011 | 2483 |
| SSP2 | SIRRHNWVNHA | 58 | 11 | 8 | 80 | | 2484 |
| SSP2 | SLLSTNLPY | 120 | 9 | 9 | 90 | 0.0280 | 2485 |
| SSP2 | SLLSTNLPYGR | 120 | 11 | 8 | 80 | | 2486 |
| SSP2 | STNLPYGR | 123 | 8 | 8 | 80 | | 2487 |
| SSP2 | SVTCGKGTR | 254 | 9 | 10 | 100 | 0.0005 | 2488 |
| SSP2 | SVTCGKGTRSR | 254 | 11 | 10 | 100 | | 2489 |
| SSP2 | TCGKGTRSR | 256 | 9 | 10 | 100 | | 2490 |
| SSP2 | TCGKGTRSRK | 256 | 10 | 10 | 100 | 0.0004 | 2491 |
| SSP2 | TCGKGTRSRKR | 256 | 11 | 10 | 100 | | 2492 |
| SSP2 | VAFNRFLVGCH | 196 | 11 | 10 | 100 | | 2493 |
| SSP2 | VCNDEVDLY | 42 | 9 | 8 | 80 | | 2494 |
| SSP2 | VCVEVEKTA | 234 | 9 | 10 | 100 | | 2495 |
| SSP2 | VFGIGQGINVA | 187 | 11 | 10 | 100 | | 2496 |
| SSP2 | VFLIFFDLF | 13 | 9 | 10 | 100 | | 2497 |
| SSP2 | VGCHPSDGK | 203 | 9 | 10 | 100 | 0.0005 | 2498 |
| SSP2 | VIGPFMKA | 226 | 8 | 10 | 100 | | 2499 |
| SSP2 | VIVFLIFF | 11 | 8 | 10 | 100 | | 2500 |
| SSP2 | VIVFLIFFDLF | 11 | 11 | 10 | 100 | | 2501 |
| SSP2 | VTCGKGTR | 255 | 8 | 10 | 100 | | 2502 |
| SSP2 | VTCGKGTRSR | 255 | 10 | 10 | 100 | 0.0004 | 2503 |
| SSP2 | VTCGKGTRSRK | 255 | 11 | 10 | 100 | | 2504 |
| SSP2 | VVPGAATPY | 521 | 9 | 8 | 80 | 0.0005 | 2505 |
| SSP2 | VVPGAATPYA | 521 | 10 | 8 | 80 | | 2506 |
| SSP2 | WSPCSVTCGK | 250 | 10 | 10 | 100 | 0.0004 | 2507 |
| SSP2 | WVNHAVPLA | 64 | 9 | 8 | 80 | 0.0002 | 2508 |
| SSP2 | WVNHAVPLAMK | 64 | 11 | 8 | 80 | | 2509 |
| SSP2 | YADSAWENVK | 215 | 10 | 10 | 100 | 0.0004 | 2510 |
| SSP2 | YAGEPAPF | 529 | 8 | 8 | 80 | | 2511 |
| SSP2 | YLLMDCSGSIR | 50 | 11 | 10 | 100 | | 2512 |
| SSP2 | YLVIVFLIF | 9 | 9 | 10 | 100 | | 2513 |
| SSP2 | YLVIVFLIFF | 9 | 10 | 10 | 100 | | 2514 |

TABLE XVII

Malaria A11 Motif Peptides With Binding Information

| Protein | Sequence | Position | No. of Amino Acids | Sequence Frequency | Conservancy (%) | A*1101 | Seq. Id. |
|---|---|---|---|---|---|---|---|
| CSP | ALFQEYQCY | 18 | 9 | 19 | 100 | 0.0021 | 2515 |
| CSP | ANANNAVK | 336 | 8 | 16 | 84 | | 2516 |
| CSP | ANPNANPNK | 305 | 9 | 19 | 100 | | 2517 |
| CSP | CGNGIQVR | 377 | 8 | 19 | 100 | | 2518 |
| CSP | CGNGIQVRIK | 377 | 10 | 19 | 100 | 0.0002 | 2519 |
| CSP | DGNNEDNEK | 96 | 9 | 19 | 100 | 0.0002 | 2520 |
| CSP | DGNNEDNEKLR | 96 | 11 | 19 | 100 | | 2521 |
| CSP | DGNNNGDNGR | 77 | 11 | 17 | 89 | | 2522 |
| CSP | DIEKKICK | 402 | 8 | 19 | 100 | | 2523 |
| CSP | DIEKKICKMEK | 402 | 11 | 19 | 100 | | 2524 |
| CSP | DNAGINLY | 41 | 8 | 18 | 95 | | 2525 |
| CSP | DNEKLRKPK | 101 | 9 | 19 | 100 | | 2526 |
| CSP | DNEKLRKPKH | 101 | 10 | 19 | 100 | | 2527 |
| CSP | DNEKLRKPKHK | 101 | 11 | 19 | 100 | | 2528 |
| CSP | DNGREGKDEDK | 84 | 11 | 19 | 100 | | 2529 |

TABLE XVII-continued

Malaria A11 Motif Peptides With Binding Information

| Protein | Sequence | Position | No. of Amino Acids | Sequence Frequency | Sequence Conservancy (%) | A*1101 | Seq. Id. |
|---|---|---|---|---|---|---|---|
| CSP | EALFQEYQCY | 17 | 10 | 19 | 100 | 0.0002 | 2530 |
| CSP | EDNEKLRK | 100 | 8 | 19 | 100 |  | 2531 |
| CSP | EDNEKLRKPK | 100 | 10 | 19 | 100 | 0.0002 | 2532 |
| CSP | EDNEKLRKPKH | 100 | 11 | 19 | 100 |  | 2533 |
| CSP | EGKDEDKR | 88 | 8 | 19 | 100 |  | 2534 |
| CSP | ELEMNYYGK | 50 | 9 | 19 | 100 | 0.0003 | 2535 |
| CSP | ENANANNAVK | 334 | 10 | 16 | 84 |  | 2536 |
| CSP | ENDIEKKICK | 400 | 10 | 19 | 100 |  | 2537 |
| CSP | ENWYSLKK | 60 | 8 | 19 | 100 |  | 2538 |
| CSP | ENWYSLKKNSR | 60 | 11 | 19 | 100 |  | 2539 |
| CSP | FLFVEALFQEY | 13 | 11 | 19 | 100 |  | 2540 |
| CSP | FVEALFQEY | 15 | 9 | 19 | 100 | 0.0003 | 2541 |
| CSP | GDNGREGK | 83 | 8 | 19 | 100 |  | 2542 |
| CSP | GNGIQVRIK | 378 | 9 | 19 | 100 |  | 2543 |
| CSP | GNNEDNEK | 97 | 8 | 19 | 100 |  | 2544 |
| CSP | GNNEDNEKLR | 97 | 10 | 19 | 100 |  | 2545 |
| CSP | GNNEDNEKLRK | 97 | 11 | 19 | 100 |  | 2546 |
| CSP | GNNNGDNGR | 78 | 10 | 19 | 100 |  | 2547 |
| CSP | HIEQYLKK | 350 | 8 | 15 | 79 |  | 2548 |
| CSP | HNMPNDPNR | 322 | 9 | 19 | 100 |  | 2549 |
| CSP | INLYNELEMNY | 45 | 11 | 18 | 95 |  | 2550 |
| CSP | KLRKPKHK | 104 | 8 | 19 | 100 |  | 2551 |
| CSP | KLRKPKHKK | 104 | 9 | 19 | 100 | 0.0037 | 2552 |
| CSP | KLRKPKHKKLK | 104 | 11 | 19 | 100 |  | 2553 |
| CSP | KNNNEEPSDK | 343 | 11 | 19 | 100 |  | 2554 |
| CSP | KNNQGNGQGH | 313 | 10 | 19 | 100 |  | 2555 |
| CSP | LDYENDIEK | 397 | 9 | 18 | 95 | 0.0002 | 2556 |
| CSP | LDYENDIEKK | 397 | 10 | 18 | 95 | 0.0002 | 2557 |
| CSP | LFQEYQCY | 19 | 8 | 19 | 100 |  | 2558 |
| CSP | LFVEALFQEY | 14 | 10 | 19 | 100 |  | 2559 |
| CSP | LNYDNAGINLY | 38 | 11 | 18 | 95 |  | 2560 |
| CSP | MNYYGKQENWY | 53 | 11 | 19 | 100 |  | 2561 |
| CSP | NANANNAVK | 335 | 9 | 16 | 84 | 0.0002 | 2562 |
| CSP | NANPNANPNK | 304 | 10 | 19 | 100 | 0.0021 | 2563 |
| CSP | NDIEKKIK | 401 | 9 | 19 | 100 | 0.0002 | 2564 |
| CSP | NGDNGREGK | 82 | 9 | 19 | 100 | 0.0002 | 2565 |
| CSP | NGIQVRIK | 379 | 8 | 19 | 100 |  | 2566 |
| CSP | NGREGKDEDK | 85 | 10 | 19 | 100 | 0.0002 | 2567 |
| CSP | NGREGKDEDKR | 85 | 11 | 19 | 100 |  | 2568 |
| CSP | NLYNELEMNY | 46 | 10 | 19 | 100 | 0.0002 | 2569 |
| CSP | NLYNELEMNYY | 46 | 11 | 19 | 100 |  | 2570 |
| CSP | NMPNDPNR | 323 | 8 | 19 | 100 |  | 2571 |
| CSP | NNEDNEKLR | 98 | 9 | 19 | 100 |  | 2572 |
| CSP | NNEDNEKLRK | 98 | 10 | 19 | 100 |  | 2573 |
| CSP | NNEEPSDK | 346 | 8 | 19 | 100 |  | 2574 |
| CSP | NNEEPSDKH | 346 | 9 | 19 | 100 |  | 2575 |
| CSP | NNGDNGREGK | 81 | 10 | 19 | 100 |  | 2576 |
| CSP | NNNEEPSDK | 345 | 9 | 19 | 100 |  | 2577 |
| CSP | NNNEEPSDKH | 345 | 10 | 19 | 100 |  | 2578 |
| CSP | NNNGDNGR | 80 | 8 | 19 | 100 |  | 2579 |
| CSP | NNNGDNGREGK | 80 | 11 | 19 | 100 |  | 2580 |
| CSP | NNNNEEPSDK | 344 | 10 | 19 | 100 |  | 2581 |
| CSP | NNNNEEPSDKH | 344 | 11 | 19 | 100 |  | 2582 |
| CSP | NNNNGDNGR | 79 | 9 | 19 | 100 |  | 2583 |
| CSP | NNQGNGQGH | 314 | 9 | 19 | 100 |  | 2584 |
| CSP | NTRVLNELNY | 31 | 10 | 19 | 100 | 0.0002 | 2585 |
| CSP | PNANPNANPNK | 303 | 11 | 19 | 100 |  | 2586 |
| CSP | PSDKHIEQY | 346 | 9 | 15 | 79 |  | 2587 |
| CSP | PSDKHIEQYLK | 346 | 11 | 15 | 79 |  | 2588 |
| CSP | QCYGSSSNTR | 24 | 10 | 19 | 100 |  | 2589 |
| CSP | QGHNMPNDPNR | 320 | 11 | 19 | 100 |  | 2590 |
| CSP | RDGNNEDNEK | 95 | 10 | 19 | 100 | 0.0002 | 2591 |
| CSP | RVLNELNY | 33 | 8 | 19 | 100 |  | 2592 |
| CSP | SDKHIEQY | 347 | 8 | 15 | 79 |  | 2593 |
| CSP | SDKHIEQYLK | 347 | 10 | 15 | 79 |  | 2594 |
| CSP | SDKHIEQYLKK | 347 | 11 | 15 | 79 |  | 2595 |
| CSP | SNTRVLNELNY | 30 | 11 | 19 | 100 |  | 2596 |
| CSP | SVTCGNGIQVR | 374 | 11 | 19 | 100 |  | 2597 |
| CSP | TCGNGIQVR | 376 | 9 | 19 | 100 |  | 2598 |
| CSP | TCGNGIQVRIK | 376 | 11 | 19 | 100 |  | 2599 |
| CSP | VTCGNGIQVR | 375 | 10 | 19 | 100 | 0.0340 | 2600 |
| CSP | YDNAGINLY | 40 | 9 | 18 | 95 |  | 2601 |
| CSP | YGKQENWY | 56 | 8 | 19 | 100 |  | 2602 |
| CSP | YGKQENWYSLK | 56 | 11 | 19 | 100 |  | 2603 |
| CSP | YGSSSNTR | 26 | 8 | 19 | 100 |  | 2604 |

TABLE XVII-continued

Malaria A11 Motif Peptides With Binding Information

| Protein | Sequence | Position | No. of Amino Acids | Sequence Frequency | Conservancy (%) | A*1101 | Seq. Id. |
|---|---|---|---|---|---|---|---|
| CSP | YNELEMNY | 48 | 8 | 19 | 100 | | 2605 |
| CSP | YNELEMNYY | 48 | 9 | 19 | 100 | | 2606 |
| CSP | YNELEMNYYGK | 48 | 11 | 19 | 100 | | 2607 |
| CSP | YSLKKNSR | 63 | 8 | 19 | 100 | | 2608 |
| EXP | ALFFIIFNK | 10 | 9 | 1 | 100 | 1.2000 | 2609 |
| EXP | DDNNLVSGPEH | 152 | 11 | 1 | 100 | | 2610 |
| EXP | DLISDMIK | 52 | 8 | 1 | 100 | | 2611 |
| EXP | DLISDMIKK | 52 | 9 | 1 | 100 | 0.0003 | 2612 |
| EXP | DNNLVSGPEH | 153 | 10 | 1 | 100 | | 2613 |
| EXP | DVHDLISDMIK | 49 | 11 | 1 | 100 | | 2614 |
| EXP | ELVEVNKR | 63 | 8 | 1 | 100 | | 2615 |
| EXP | ELVEVNKRK | 63 | 9 | 1 | 100 | 0.0002 | 2616 |
| EXP | ELVEVNKRKSK | 63 | 11 | 1 | 100 | | 2617 |
| EXP | ESLAEKTNK | 19 | 9 | 1 | 100 | 0.0002 | 2618 |
| EXP | EVNKRKSK | 66 | 8 | 1 | 100 | | 2619 |
| EXP | EVNKRKSKY | 66 | 9 | 1 | 100 | 0.0002 | 2620 |
| EXP | EVNKRKSKYK | 66 | 10 | 1 | 100 | 0.0002 | 2621 |
| EXP | FLALFFIIFNK | 8 | 11 | 1 | 100 | | 2622 |
| EXP | FNKESLAEK | 16 | 9 | 1 | 100 | | 2623 |
| EXP | GGVGLVLY | 94 | 8 | 1 | 100 | | 2624 |
| EXP | GLVLYNTEK | 97 | 9 | 1 | 100 | 0.0055 | 2625 |
| EXP | GLVLYNTEKGR | 97 | 11 | 1 | 100 | | 2626 |
| EXP | GSGEPLIDVH | 42 | 10 | 1 | 100 | 0.0002 | 2627 |
| EXP | GSGVSSKK | 30 | 8 | 1 | 100 | | 2628 |
| EXP | GSGVSSKKK | 30 | 9 | 1 | 100 | 0.0065 | 2629 |
| EXP | GSGVSSKKKNK | 30 | 11 | 1 | 100 | | 2630 |
| EXP | GTGSGVSSK | 28 | 9 | 1 | 100 | 0.0180 | 2631 |
| EXP | GTGSGVSSKK | 28 | 10 | 1 | 100 | 0.0340 | 2632 |
| EXP | GTGSGVSSKKK | 28 | 11 | 1 | 100 | | 2633 |
| EXP | GVGLVLYNTEK | 95 | 11 | 1 | 100 | | 2634 |
| EXP | GVSSKKKNK | 32 | 9 | 1 | 100 | 0.0002 | 2635 |
| EXP | GVSSKKKNKK | 32 | 10 | 1 | 100 | 0.0002 | 2636 |
| EXP | HDLISDMIK | 51 | 9 | 1 | 100 | 0.0002 | 2637 |
| EXP | HDLISDMIKK | 51 | 10 | 1 | 100 | 0.0002 | 2638 |
| EXP | IFNKESLAEK | 15 | 10 | 1 | 100 | 0.0003 | 2639 |
| EXP | IIFNKESLAEK | 14 | 11 | 1 | 100 | | 2640 |
| EXP | KGSGEPLIDVH | 41 | 11 | 1 | 100 | | 2641 |
| EXP | KGTGSGVSSK | 27 | 10 | 1 | 100 | 0.0009 | 2642 |
| EXP | KGTGSGVSSKK | 27 | 11 | 1 | 100 | | 2643 |
| EXP | LALFFIIFNK | 9 | 10 | 1 | 100 | 0.0530 | 2644 |
| EXP | LFFIIFNK | 11 | 8 | 1 | 100 | | 2645 |
| EXP | LGGVGLVLY | 93 | 9 | 1 | 100 | 0.0002 | 2646 |
| EXP | LISDMIKK | 53 | 8 | 1 | 100 | | 2647 |
| EXP | LLGGVGLVLY | 92 | 10 | 1 | 100 | 0.0003 | 2648 |
| EXP | LVEVNKRK | 64 | 8 | 1 | 100 | | 2649 |
| EXP | LVEVNKRKSK | 64 | 10 | 1 | 100 | 0.0002 | 2650 |
| EXP | LVEVNKRKSKY | 64 | 11 | 1 | 100 | | 2651 |
| EXP | LVLYNTEK | 98 | 8 | 1 | 100 | | 2652 |
| EXP | LVLYNTEKGR | 98 | 10 | 1 | 100 | 0.0002 | 2653 |
| EXP | LVLYNTEKGRH | 98 | 11 | 1 | 100 | | 2654 |
| EXP | NLVSGPEH | 155 | 8 | 1 | 100 | | 2655 |
| EXP | NNLVSGPEH | 154 | 9 | 1 | 100 | | 2656 |
| EXP | NTEKGRHPFK | 102 | 10 | 1 | 100 | 0.0080 | 2657 |
| EXP | SGEPLIDVH | 43 | 9 | 1 | 100 | 0.0002 | 2658 |
| EXP | SGVSSKKK | 31 | 8 | 1 | 100 | | 2659 |
| EXP | SGVSSKKKNK | 31 | 10 | 1 | 100 | 0.0002 | 2660 |
| EXP | SGVSSKKKNKK | 31 | 11 | 1 | 100 | | 2661 |
| EXP | SLAEKTNK | 20 | 8 | 1 | 100 | | 2662 |
| EXP | SSKKKNKK | 34 | 8 | 1 | 100 | | 2663 |
| EXP | TGSGVSSK | 29 | 8 | 1 | 100 | | 2664 |
| EXP | TGSGVSSKK | 29 | 9 | 1 | 100 | 0.0016 | 2665 |
| EXP | TGSGVSSKKK | 29 | 10 | 1 | 100 | 0.0002 | 2666 |
| EXP | VGLVLYNTEK | 96 | 10 | 1 | 100 | 0.0052 | 2667 |
| EXP | VLLGGVGLVLY | 91 | 11 | 1 | 100 | | 2668 |
| EXP | VLYNTEKGR | 99 | 9 | 1 | 100 | 0.0007 | 2669 |
| EXP | VLYNTEKGRH | 99 | 10 | 1 | 100 | 0.0002 | 2670 |
| EXP | VNKRKSKY | 67 | 8 | 1 | 100 | | 2671 |
| EXP | VNKRKSKYK | 67 | 9 | 1 | 100 | | 2672 |
| EXP | VSSKKKNK | 33 | 8 | 1 | 100 | | 2673 |
| EXP | VSSKKKNKK | 33 | 9 | 1 | 100 | 0.0002 | 2674 |
| EXP | YNTEKGRH | 101 | 8 | 1 | 100 | | 2675 |
| EXP | YNTEKGRHPFK | 101 | 11 | 1 | 100 | | 2676 |
| LSA | ADTKKNLER | 1632 | 9 | 1 | 100 | | 2677 |
| LSA | ADTKKNLERK | 1632 | 10 | 1 | 100 | 0.0003 | 2678 |
| LSA | ADTKKNLERKK | 1632 | 11 | 1 | 100 | | 2679 |

TABLE XVII-continued

Malaria A11 Motif Peptides With Binding Information

| Protein | Sequence | Position | No. of Amino Acids | Sequence Frequency | Conservancy (%) | A*1101 | Seq. Id. |
|---|---|---|---|---|---|---|---|
| LSA | AIELPSENER | 1660 | 10 | 1 | 100 | 0.0002 | 2680 |
| LSA | ANEKLQEQQR | 1531 | 10 | 1 | 100 | | 2681 |
| LSA | DDDDKKKY | 130 | 8 | 1 | 100 | | 2682 |
| LSA | DDDDKKKYIK | 130 | 10 | 1 | 100 | 0.0002 | 2683 |
| LSA | DDDKKKYIK | 131 | 9 | 1 | 100 | 0.0002 | 2684 |
| LSA | DDEDLDEFK | 1778 | 9 | 1 | 100 | 0.0002 | 2685 |
| LSA | DDKKKYIK | 132 | 8 | 1 | 100 | | 2686 |
| LSA | DDLDEGIEK | 1817 | 9 | 1 | 100 | 0.0002 | 2687 |
| LSA | DGSIKPEQK | 1724 | 9 | 1 | 100 | 0.0002 | 2688 |
| LSA | DIHKGHLEEK | 1713 | 10 | 1 | 100 | 0.0002 | 2689 |
| LSA | DIHKGHLEEKK | 1713 | 11 | 1 | 100 | | 2690 |
| LSA | DITKYFMK | 1901 | 8 | 1 | 100 | | 2691 |
| LSA | DLDEFKPIVQY | 1781 | 11 | 1 | 100 | | 2692 |
| LSA | DLDEGIEK | 1818 | 8 | 1 | 100 | | 2693 |
| LSA | DLEEKAAK | 148 | 8 | 1 | 100 | | 2694 |
| LSA | DLEQDRLAK | 1388 | 9 | 1 | 100 | 0.0002 | 2695 |
| LSA | DLEQDRLAKEK | 1388 | 11 | 1 | 100 | | 2696 |
| LSA | DLEQERLAK | 1609 | 9 | 1 | 100 | 0.0002 | 2697 |
| LSA | DLEQERLAKEK | 1609 | 11 | 1 | 100 | | 2698 |
| LSA | DLEQERLANEK | 1524 | 11 | 1 | 100 | | 2699 |
| LSA | DLEQERRAK | 1575 | 9 | 1 | 100 | 0.0002 | 2700 |
| LSA | DLEQERRAKEK | 1575 | 11 | 1 | 100 | | 2701 |
| LSA | DLEQRKADTK | 1626 | 10 | 1 | 100 | 0.0002 | 2702 |
| LSA | DLEQRKADTKK | 1626 | 11 | 1 | 100 | | 2703 |
| LSA | DLERTKASK | 1184 | 9 | 1 | 100 | 0.0002 | 2704 |
| LSA | DNNFKPNDK | 1846 | 9 | 1 | 100 | | 2705 |
| LSA | DNRGNSRDSK | 1682 | 10 | 1 | 100 | | 2706 |
| LSA | DSEQERLAK | 521 | 9 | 1 | 100 | 0.0002 | 2707 |
| LSA | DSEQERLAKEK | 521 | 11 | 1 | 100 | | 2708 |
| LSA | DSKEISIIEK | 1689 | 10 | 1 | 100 | 0.0002 | 2709 |
| LSA | DTKKNLER | 1633 | 8 | 1 | 100 | | 2710 |
| LSA | DTKKNLERK | 1633 | 9 | 1 | 100 | 0.0002 | 2711 |
| LSA | DTKKNLERKK | 1633 | 10 | 1 | 100 | 0.0002 | 2712 |
| LSA | DVLAEDLY | 1646 | 8 | 1 | 100 | | 2713 |
| LSA | DVLAEDLYGR | 1646 | 10 | 1 | 100 | 0.0002 | 2714 |
| LSA | DVNDFQISK | 1751 | 9 | 1 | 100 | 0.0018 | 2715 |
| LSA | DVNDFQISKY | 1751 | 10 | 1 | 100 | 0.0002 | 2716 |
| LSA | EDDEDLDEFK | 1777 | 10 | 1 | 100 | 0.0002 | 2717 |
| LSA | EDEISAEY | 1761 | 8 | 1 | 100 | | 2718 |
| LSA | EDITKYFMK | 1900 | 9 | 1 | 100 | 0.0003 | 2719 |
| LSA | EDKSADIQNH | 1733 | 10 | 1 | 100 | | 2720 |
| LSA | EDLEEKAAK | 147 | 9 | 1 | 100 | 0.0002 | 2721 |
| LSA | EFKPIVQY | 1784 | 8 | 1 | 100 | | 2722 |
| LSA | EGRRDIHK | 1709 | 8 | 1 | 100 | | 2723 |
| LSA | EGRRDIHKGH | 1709 | 10 | 1 | 100 | 0.0002 | 2724 |
| LSA | EIIKSNLR | 33 | 8 | 1 | 100 | | 2725 |
| LSA | EISIIEKTNR | 1692 | 10 | 1 | 100 | 0.0002 | 2726 |
| LSA | ELEDLIEK | 1805 | 8 | 1 | 100 | | 2727 |
| LSA | ELPSENER | 1662 | 8 | 1 | 100 | | 2728 |
| LSA | ELPSENERGY | 1662 | 10 | 1 | 100 | 0.0002 | 2729 |
| LSA | ELPSENERGYY | 1662 | 11 | 1 | 100 | | 2730 |
| LSA | ELSEDITK | 1897 | 8 | 1 | 100 | | 2731 |
| LSA | ELSEDITKY | 1897 | 9 | 1 | 100 | 0.0002 | 2732 |
| LSA | ELSEEKIK | 1829 | 8 | 1 | 100 | | 2733 |
| LSA | ELSEEKIKK | 1829 | 9 | 1 | 100 | 0.0002 | 2734 |
| LSA | ELSEEKIKKGK | 1829 | 11 | 1 | 100 | | 2735 |
| LSA | ELTMSNVK | 83 | 8 | 1 | 100 | | 2736 |
| LSA | ENERGYYIPH | 1666 | 10 | 1 | 100 | | 2737 |
| LSA | ENIFLKENK | 108 | 9 | 1 | 100 | | 2738 |
| LSA | ENKLNKEGK | 114 | 9 | 1 | 100 | | 2739 |
| LSA | ENNKFFDK | 73 | 8 | 1 | 100 | | 2740 |
| LSA | ENNKFFDKDK | 73 | 10 | 1 | 100 | | 2741 |
| LSA | ENRQEDLEEK | 143 | 10 | 1 | 100 | | 2742 |
| LSA | ESITTNVEGR | 1702 | 10 | 1 | 100 | 0.0002 | 2743 |
| LSA | ESITTNVEGRR | 1702 | 11 | 1 | 100 | | 2744 |
| LSA | FILVNLLIFH | 11 | 10 | 1 | 100 | 0.0060 | 2745 |
| LSA | FLKENKLNK | 111 | 9 | 1 | 100 | 0.0005 | 2746 |
| LSA | GDVLAEDLY | 1645 | 9 | 1 | 100 | | 2747 |
| LSA | GDVLAEDLYGR | 1645 | 11 | 1 | 100 | | 2748 |
| LSA | GSIKPEQK | 1725 | 8 | 1 | 100 | | 2749 |
| LSA | GSIKPEQKEDK | 1725 | 11 | 1 | 100 | | 2750 |
| LSA | GSSNSRNR | 42 | 8 | 1 | 100 | | 2751 |
| LSA | GVSENIFLK | 105 | 9 | 1 | 100 | 0.6600 | 2752 |
| LSA | HGDVLAEDLY | 1644 | 10 | 1 | 100 | 0.0002 | 2753 |
| LSA | HIINDDDDK | 126 | 9 | 1 | 100 | 0.0002 | 2754 |

TABLE XVII-continued

Malaria A11 Motif Peptides With Binding Information

| Protein | Sequence | Position | No. of Amino Acids | Sequence Frequency | Conservancy (%) | A*1101 | Seq. Id. |
|---|---|---|---|---|---|---|---|
| LSA | HIINDDDDKK | 126 | 10 | 1 | 100 | 0.0002 | 2755 |
| LSA | HIINDDDDKKK | 126 | 11 | 1 | 100 | | 2756 |
| LSA | HIKKYKNDK | 1860 | 9 | 1 | 100 | 0.0002 | 2757 |
| LSA | HILYISFY | 3 | 8 | 1 | 100 | | 2758 |
| LSA | HINGKIIK | 20 | 8 | 1 | 100 | | 2759 |
| LSA | HLEEKKDGSIK | 1718 | 11 | 1 | 100 | | 2760 |
| LSA | HNSYEKTK | 63 | 8 | 1 | 100 | | 2761 |
| LSA | HVLSHNSY | 59 | 8 | 1 | 100 | | 2762 |
| LSA | HVLSHNSYEK | 59 | 10 | 1 | 100 | 0.0140 | 2763 |
| LSA | IFHINGKIIK | 18 | 10 | 1 | 100 | 0.0006 | 2764 |
| LSA | IFLKENKLNK | 110 | 10 | 1 | 100 | 0.0002 | 2765 |
| LSA | IINDDDDK | 127 | 8 | 1 | 100 | | 2766 |
| LSA | IINDDDDKK | 127 | 9 | 1 | 100 | 0.0002 | 2767 |
| LSA | IINDDDDKKK | 127 | 10 | 1 | 100 | 0.0002 | 2768 |
| LSA | IINDDDDKKKY | 127 | 11 | 1 | 100 | | 2769 |
| LSA | ILVNLLIFH | 12 | 9 | 1 | 100 | 0.0008 | 2770 |
| LSA | INDDDDKK | 128 | 8 | 1 | 100 | | 2771 |
| LSA | INDDDDKKK | 128 | 9 | 1 | 100 | | 2772 |
| LSA | INDDDDKKKY | 128 | 10 | 1 | 100 | | 2773 |
| LSA | INEEKHEK | 50 | 8 | 1 | 100 | | 2774 |
| LSA | INEEKHEKK | 50 | 9 | 1 | 100 | | 2775 |
| LSA | INEEKHEKKH | 50 | 10 | 1 | 100 | | 2776 |
| LSA | INGKIIKNSEK | 21 | 11 | 1 | 100 | | 2777 |
| LSA | ISDVNDFQISK | 1749 | 11 | 1 | 100 | | 2778 |
| LSA | ISIIEKTNR | 1693 | 9 | 1 | 100 | 0.0008 | 2779 |
| LSA | ITTNVEGR | 1704 | 8 | 1 | 100 | | 2780 |
| LSA | ITTNVEGRR | 1704 | 9 | 1 | 100 | 0.0007 | 2781 |
| LSA | IVDELSEDITK | 1894 | 11 | 1 | 100 | | 2782 |
| LSA | KADTKKNLER | 1631 | 10 | 1 | 100 | 0.0002 | 2783 |
| LSA | KADTKKNLERK | 1631 | 11 | 1 | 100 | | 2784 |
| LSA | KDEIIKSNLR | 31 | 10 | 1 | 100 | | 2785 |
| LSA | KDGSIKPEQK | 1723 | 10 | 1 | 100 | 0.0002 | 2786 |
| LSA | KDKELTMSNVK | 80 | 11 | 1 | 100 | | 2787 |
| LSA | KDNNFKPNDK | 1845 | 10 | 1 | 100 | 0.0002 | 2788 |
| LSA | KFIKSLFH | 1876 | 8 | 1 | 100 | | 2789 |
| LSA | KGHLEEKK | 1716 | 8 | 1 | 100 | | 2790 |
| LSA | KGKKYEKTK | 1837 | 9 | 1 | 100 | 0.0002 | 2791 |
| LSA | KIIKNSEK | 24 | 8 | 1 | 100 | | 2792 |
| LSA | KIKKGKKY | 1834 | 8 | 1 | 100 | | 2793 |
| LSA | KIKKGKKYEK | 1834 | 10 | 1 | 100 | 0.0007 | 2794 |
| LSA | KLNKEGKLIEH | 116 | 11 | 1 | 100 | | 2795 |
| LSA | KLQEQQSDLER | 1177 | 11 | 1 | 100 | | 2796 |
| LSA | KNDKQVNK | 1865 | 8 | 1 | 100 | | 2797 |
| LSA | KNDKQVNKEK | 1865 | 10 | 1 | 100 | | 2798 |
| LSA | KNLERKKEH | 1636 | 9 | 1 | 100 | | 2799 |
| LSA | KNNENNKFFDK | 70 | 11 | 1 | 100 | | 2800 |
| LSA | KNSEKDEIIK | 27 | 10 | 1 | 100 | | 2801 |
| LSA | KNVSQTNFK | 90 | 9 | 1 | 100 | | 2802 |
| LSA | KSADIQNH | 1735 | 8 | 1 | 100 | | 2803 |
| LSA | KSLYDEHIK | 1854 | 9 | 1 | 100 | 0.0340 | 2804 |
| LSA | KSLYDEHIKK | 1854 | 10 | 1 | 100 | 0.0490 | 2805 |
| LSA | KSLYDEHIKKY | 1854 | 11 | 1 | 100 | | 2806 |
| LSA | KSSEELSEEK | 1825 | 10 | 1 | 100 | 0.0009 | 2807 |
| LSA | KTKDNNFK | 1843 | 8 | 1 | 100 | | 2808 |
| LSA | KTKNNENNK | 68 | 9 | 1 | 100 | 0.0038 | 2809 |
| LSA | LAEDLYGR | 1648 | 8 | 1 | 100 | | 2810 |
| LSA | LAKEKLQEQQR | 1615 | 11 | 1 | 100 | | 2811 |
| LSA | LANEKLQEQQR | 1530 | 11 | 1 | 100 | | 2812 |
| LSA | LDDLDEGIEK | 1816 | 10 | 1 | 100 | 0.0002 | 2813 |
| LSA | LDEFKPIVQY | 1782 | 10 | 1 | 100 | | 2814 |
| LSA | LGVSENIFLK | 104 | 10 | 1 | 100 | 0.0063 | 2815 |
| LSA | LIFHINGK | 17 | 8 | 1 | 100 | | 2816 |
| LSA | LIFHINGKIIK | 17 | 11 | 1 | 100 | | 2817 |
| LSA | LLIFHINGK | 16 | 9 | 1 | 100 | 0.0100 | 2818 |
| LSA | LNKEGKLIEH | 117 | 10 | 1 | 100 | | 2819 |
| LSA | LSEDITKY | 1898 | 8 | 1 | 100 | | 2820 |
| LSA | LSEDITKYFMK | 1898 | 11 | 1 | 100 | | 2821 |
| LSA | LSEEKIKK | 1830 | 8 | 1 | 100 | | 2822 |
| LSA | LSEEKIKKGK | 1830 | 10 | 1 | 100 | 0.0002 | 2823 |
| LSA | LSEEKIKKGKK | 1830 | 11 | 1 | 100 | | 2824 |
| LSA | LSHNSYEK | 61 | 8 | 1 | 100 | | 2825 |
| LSA | LSHNSYEKTK | 61 | 10 | 1 | 100 | 0.0002 | 2826 |
| LSA | LVNLLIFH | 13 | 8 | 1 | 100 | | 2827 |
| LSA | NDDDDKKK | 129 | 8 | 1 | 100 | | 2828 |
| LSA | NDDDDKKKY | 129 | 9 | 1 | 100 | | 2829 |

TABLE XVII-continued

Malaria A11 Motif Peptides With Binding Information

| Protein | Sequence | Position | No. of Amino Acids | Sequence Frequency | Conservancy (%) | A*1101 | Seq. Id. |
|---|---|---|---|---|---|---|---|
| LSA | NDDDDKKKYIK | 129 | 11 | 1 | 100 | | 2830 |
| LSA | NDFQISKY | 1753 | 8 | 1 | 100 | | 2831 |
| LSA | NDKQVNKEK | 1866 | 9 | 1 | 100 | 0.0002 | 2832 |
| LSA | NDKQVNKEKEK | 1866 | 11 | 1 | 100 | | 2833 |
| LSA | NDKSLYDEH | 1852 | 9 | 1 | 100 | | 2834 |
| LSA | NDKSLYDEHIK | 1852 | 11 | 1 | 100 | | 2835 |
| LSA | NFKPNDKSLY | 1848 | 10 | 1 | 100 | | 2836 |
| LSA | NFQDEENIGIY | 1793 | 11 | 1 | 100 | | 2837 |
| LSA | NGKIIKNSEK | 22 | 10 | 1 | 100 | 0.0002 | 2838 |
| LSA | NIFLKENK | 109 | 8 | 1 | 100 | | 2839 |
| LSA | NIFLKENKLNK | 109 | 11 | 1 | 100 | | 2840 |
| LSA | NLDDLDEGIEK | 1815 | 11 | 1 | 100 | | 2841 |
| LSA | NLERKKEH | 1637 | 8 | 1 | 100 | | 2842 |
| LSA | NLGVSENIFLK | 103 | 11 | 1 | 100 | | 2843 |
| LSA | NLLIFHINGK | 15 | 10 | 1 | 100 | 0.0008 | 2844 |
| LSA | NLRSGSSNSR | 38 | 10 | 1 | 100 | 0.0002 | 2845 |
| LSA | NNENNKFFDK | 71 | 10 | 1 | 100 | | 2846 |
| LSA | NNFKPNDK | 1847 | 8 | 1 | 100 | | 2847 |
| LSA | NNFKPNDKSLY | 1847 | 11 | 1 | 100 | | 2848 |
| LSA | NNKFFDKDK | 74 | 9 | 1 | 100 | | 2849 |
| LSA | NSEKDEIIK | 28 | 9 | 1 | 100 | 0.0002 | 2850 |
| LSA | NSRNRINEEK | 45 | 10 | 1 | 100 | 0.0002 | 2851 |
| LSA | NSRNRINEEKH | 45 | 11 | 1 | 100 | | 2852 |
| LSA | NVEGRRDIH | 1707 | 9 | 1 | 100 | 0.0002 | 2853 |
| LSA | NVEGRRDIHK | 1707 | 10 | 1 | 100 | 0.0002 | 2854 |
| LSA | NVKNVSQTNFK | 88 | 11 | 1 | 100 | | 2855 |
| LSA | NVSQTNFK | 91 | 8 | 1 | 100 | | 2856 |
| LSA | PAIELPSENER | 1659 | 11 | 1 | 100 | | 2857 |
| LSA | PNDKSLYDEH | 1851 | 10 | 1 | 100 | | 2858 |
| LSA | PSENERGY | 1664 | 8 | 1 | 100 | | 2859 |
| LSA | PSENERGYY | 1664 | 9 | 1 | 100 | 0.0002 | 2860 |
| LSA | QDEENIGIY | 1795 | 9 | 1 | 100 | | 2861 |
| LSA | QDEENIGIYK | 1795 | 10 | 1 | 100 | 0.0002 | 2862 |
| LSA | QDNRGNSR | 1681 | 8 | 1 | 100 | | 2863 |
| LSA | QDNRGNSRDSK | 1681 | 11 | 1 | 100 | | 2864 |
| LSA | QDRLAKEK | 1391 | 8 | 1 | 100 | | 2865 |
| LSA | QGQQSDLEQER | 1128 | 11 | 1 | 100 | | 2866 |
| LSA | QSDLEQDR | 1386 | 8 | 1 | 100 | | 2867 |
| LSA | QSDLEQDRLAK | 1386 | 11 | 1 | 100 | | 2868 |
| LSA | QSDLEQER | 1590 | 8 | 1 | 100 | | 2869 |
| LSA | QSDLEQERLAK | 1590 | 11 | 1 | 100 | | 2870 |
| LSA | QSDLEQERR | 1573 | 9 | 1 | 100 | 0.0002 | 2871 |
| LSA | QSDLEQERRAK | 1573 | 11 | 1 | 100 | | 2872 |
| LSA | QSDLERTK | 1182 | 8 | 1 | 100 | | 2873 |
| LSA | QSDLERTKASK | 1182 | 11 | 1 | 100 | | 2874 |
| LSA | QSDSEQER | 519 | 8 | 1 | 100 | | 2875 |
| LSA | QSDSEQERLAK | 519 | 11 | 1 | 100 | | 2876 |
| LSA | QSSLPQDNR | 1676 | 9 | 1 | 100 | 0.0013 | 2877 |
| LSA | QTNFKSLLR | 94 | 9 | 1 | 100 | 0.0440 | 2878 |
| LSA | QVNKEKEK | 1869 | 8 | 1 | 100 | | 2879 |
| LSA | QVNKEKEKFIK | 1869 | 11 | 1 | 100 | | 2880 |
| LSA | RDIHKGHLEEK | 1712 | 11 | 1 | 100 | | 2881 |
| LSA | RDLEQERLAK | 1608 | 10 | 1 | 100 | 0.0002 | 2882 |
| LSA | RDLEQERR | 1540 | 8 | 1 | 100 | | 2883 |
| LSA | RDLEQERRAK | 1540 | 10 | 1 | 100 | 0.0002 | 2884 |
| LSA | RDLEQRKADTK | 1625 | 11 | 1 | 100 | | 2885 |
| LSA | RDSKEISIIEK | 1688 | 11 | 1 | 100 | | 2886 |
| LSA | RGNSRDSK | 1684 | 8 | 1 | 100 | | 2887 |
| LSA | RINEEKHEK | 49 | 9 | 1 | 100 | 0.0370 | 2888 |
| LSA | RINEEKHEKK | 49 | 10 | 1 | 100 | 0.0018 | 2889 |
| LSA | RINEEKHEKKH | 49 | 11 | 1 | 100 | | 2890 |
| LSA | RNRINEEK | 47 | 8 | 1 | 100 | | 2891 |
| LSA | RNRINEEKH | 47 | 9 | 1 | 100 | | 2892 |
| LSA | RNRINEEKHEK | 47 | 11 | 1 | 100 | | 2893 |
| LSA | RSGSSNSR | 40 | 8 | 1 | 100 | | 2894 |
| LSA | RSGSSNSRNR | 40 | 10 | 1 | 100 | 0.0002 | 2895 |
| LSA | SDLEQDRLAK | 1387 | 10 | 1 | 100 | 0.0002 | 2896 |
| LSA | SDLEQERLAK | 1591 | 10 | 1 | 100 | 0.0002 | 2897 |
| LSA | SDLEQERR | 1574 | 8 | 1 | 100 | | 2898 |
| LSA | SDLEQERRAK | 1574 | 10 | 1 | 100 | 0.0002 | 2899 |
| LSA | SDLERTKASK | 1183 | 10 | 1 | 100 | 0.0002 | 2900 |
| LSA | SDSEQERLAK | 520 | 10 | 1 | 100 | 0.0002 | 2901 |
| LSA | SDVNDFQISK | 1750 | 10 | 1 | 100 | 0.0002 | 2902 |
| LSA | SDVNDFQISKY | 1750 | 11 | 1 | 100 | | 2903 |
| LSA | SGSSNSRNR | 41 | 9 | 1 | 100 | 0.0030 | 2904 |

TABLE XVII-continued

Malaria A11 Motif Peptides With Binding Information

| Protein | Sequence | Position | No. of Amino Acids | Sequence Frequency | Conservancy (%) | A*1101 | Seq. Id. |
|---|---|---|---|---|---|---|---|
| LSA | SIIEKTNR | 1694 | 8 | 1 | 100 | | 2905 |
| LSA | SIKPEQKEDK | 1726 | 10 | 1 | 100 | 0.0002 | 2906 |
| LSA | SITTNVEGR | 1703 | 9 | 1 | 100 | 0.0027 | 2907 |
| LSA | SITTNVEGRR | 1703 | 10 | 1 | 100 | 0.0002 | 2908 |
| LSA | SLPQDNRGNSR | 1678 | 11 | 1 | 100 | | 2909 |
| LSA | SLYDEHIK | 1855 | 8 | 1 | 100 | | 2910 |
| LSA | SLYDEHIKK | 1855 | 9 | 1 | 100 | 0.4100 | 2911 |
| LSA | SLYDEHIKKY | 1855 | 10 | 1 | 100 | 0.0045 | 2912 |
| LSA | SLYDEHIKKYK | 1855 | 11 | 1 | 100 | | 2913 |
| LSA | SNLRSGSSNSR | 37 | 11 | 1 | 100 | | 2914 |
| LSA | SNSRNRINEEK | 44 | 11 | 1 | 100 | | 2915 |
| LSA | SSEELSEEK | 1826 | 9 | 1 | 100 | 0.0017 | 2916 |
| LSA | SSEELSEEKIK | 1826 | 11 | 1 | 100 | | 2917 |
| LSA | SSLPQDNR | 1677 | 8 | 1 | 100 | | 2918 |
| LSA | TNFKSLLR | 95 | 8 | 1 | 100 | | 2919 |
| LSA | TNVEGRRDIH | 1706 | 10 | 1 | 100 | | 2920 |
| LSA | TNVEGRRDIHK | 1706 | 11 | 1 | 100 | | 2921 |
| LSA | TTNVEGRR | 1705 | 8 | 1 | 100 | | 2922 |
| LSA | TTNVEGRRDIH | 1705 | 11 | 1 | 100 | | 2923 |
| LSA | VDELSEDITK | 1895 | 10 | 1 | 100 | 0.0002 | 2924 |
| LSA | VDELSEDITKY | 1895 | 11 | 1 | 100 | | 2925 |
| LSA | VLAEDLYGR | 1647 | 9 | 1 | 100 | 0.0004 | 2926 |
| LSA | VLSHNSYEK | 60 | 9 | 1 | 100 | 0.0280 | 2927 |
| LSA | VLSHNSYEKTK | 60 | 11 | 1 | 100 | | 2928 |
| LSA | VNDFQISK | 1752 | 8 | 1 | 100 | | 2929 |
| LSA | VNDFQISKY | 1752 | 9 | 1 | 100 | | 2930 |
| LSA | VNKEKEKFIK | 1870 | 10 | 1 | 100 | | 2931 |
| LSA | VNLLIFHINGK | 14 | 11 | 1 | 100 | | 2932 |
| LSA | VSENIFLK | 106 | 8 | 1 | 100 | | 2933 |
| LSA | VSENIFLKENK | 106 | 11 | 1 | 100 | | 2934 |
| LSA | VSQTNFKSLLR | 92 | 11 | 1 | 100 | | 2935 |
| LSA | YDEHIKKY | 1857 | 8 | 1 | 100 | | 2936 |
| LSA | YDEHIKKYK | 1857 | 9 | 1 | 100 | 0.0002 | 2937 |
| LSA | YFILVNLLIFH | 10 | 11 | 1 | 100 | | 2938 |
| LSA | YIKGQDENR | 137 | 9 | 1 | 100 | 0.0002 | 2939 |
| SSP2 | ACAGLAYK | 512 | 8 | 10 | 100 | | 2940 |
| SSP2 | ADSAWENVK | 216 | 9 | 10 | 100 | 0.0009 | 2941 |
| SSP2 | AFNRFLVGCH | 197 | 10 | 10 | 100 | | 2942 |
| SSP2 | ALLACAGLAY | 509 | 10 | 10 | 100 | 0.0110 | 2943 |
| SSP2 | ALLACAGLAYK | 509 | 11 | 10 | 100 | | 2944 |
| SSP2 | ALLQVRKH | 136 | 8 | 9 | 90 | | 2945 |
| SSP2 | AVCVEVEK | 233 | 8 | 10 | 100 | | 2946 |
| SSP2 | CGKGTRSR | 257 | 8 | 10 | 100 | | 2947 |
| SSP2 | CGKGTRSRK | 257 | 9 | 10 | 100 | 0.0002 | 2948 |
| SSP2 | CGKGTRSRKR | 257 | 10 | 10 | 100 | 0.0002 | 2949 |
| SSP2 | CNDEVDLY | 43 | 8 | 8 | 80 | | 2950 |
| SSP2 | CSGSIRRH | 55 | 8 | 10 | 100 | | 2951 |
| SSP2 | CSVTCGKGTR | 253 | 10 | 10 | 100 | 0.0002 | 2952 |
| SSP2 | DALLQVRK | 135 | 8 | 9 | 90 | | 2953 |
| SSP2 | DALLQVRKH | 135 | 9 | 9 | 90 | 0.0002 | 2954 |
| SSP2 | DASKNKEK | 106 | 8 | 10 | 100 | | 2955 |
| SSP2 | DCSGSIRR | 54 | 8 | 10 | 100 | | 2956 |
| SSP2 | DCSGSIRRH | 54 | 9 | 10 | 100 | | 2957 |
| SSP2 | DDREENFDIPK | 385 | 11 | 10 | 100 | | 2958 |
| SSP2 | DIPKKPENK | 392 | 9 | 10 | 100 | 0.0002 | 2959 |
| SSP2 | DIPKKPENKH | 392 | 10 | 10 | 100 | 0.0002 | 2960 |
| SSP2 | DLDEPEQFR | 546 | 9 | 10 | 100 | 0.0002 | 2961 |
| SSP2 | DLFLVNGR | 19 | 8 | 10 | 100 | | 2962 |
| SSP2 | DNQNNLPNDK | 402 | 10 | 10 | 100 | | 2963 |
| SSP2 | DSAWENVK | 217 | 8 | 10 | 100 | | 2964 |
| SSP2 | DSIQDSLK | 166 | 8 | 10 | 100 | | 2965 |
| SSP2 | DSIQDSLKESR | 166 | 11 | 10 | 100 | | 2966 |
| SSP2 | DSLKESRK | 170 | 8 | 9 | 90 | | 2967 |
| SSP2 | DVPKNPEDDR | 378 | 10 | 10 | 100 | 0.0002 | 2968 |
| SSP2 | DVQNNIVDEIK | 27 | 11 | 10 | 100 | | 2969 |
| SSP2 | EDDQPRPR | 300 | 8 | 10 | 100 | | 2970 |
| SSP2 | EDRETRPH | 450 | 8 | 9 | 90 | | 2971 |
| SSP2 | EDRETRPHGR | 450 | 10 | 9 | 90 | | 2972 |
| SSP2 | EIIRLHSDASK | 99 | 11 | 10 | 100 | | 2973 |
| SSP2 | ELQEQCEEER | 276 | 10 | 8 | 80 | 0.0002 | 2974 |
| SSP2 | ENFDIPKK | 389 | 8 | 10 | 100 | | 2975 |
| SSP2 | ENRSYNRK | 462 | 8 | 10 | 100 | | 2976 |
| SSP2 | ETLGEEDK | 538 | 8 | 10 | 100 | | 2977 |
| SSP2 | EVCNDEVDLY | 41 | 10 | 8 | 80 | 0.0002 | 2978 |
| SSP2 | EVPSDVPK | 374 | 8 | 10 | 100 | | 2979 |

TABLE XVII-continued

Malaria A11 Motif Peptides With Binding Information

| Protein | Sequence | Position | No. of Amino Acids | Sequence Frequency | Sequence Conservancy (%) | A*1101 | Seq. Id. |
|---|---|---|---|---|---|---|---|
| SSP2 | FDETLGEEDK | 536 | 10 | 10 | 100 | 0.0002 | 2980 |
| SSP2 | FDIPKKPENK | 391 | 10 | 10 | 100 | 0.0002 | 2981 |
| SSP2 | FDIPKKPENKH | 391 | 11 | 10 | 100 | | 2982 |
| SSP2 | FDLFLVNGR | 18 | 9 | 10 | 100 | | 2983 |
| SSP2 | FFDLFLVNGR | 17 | 10 | 10 | 100 | | 2984 |
| SSP2 | FLVGCHPSDGK | 201 | 11 | 10 | 100 | | 2985 |
| SSP2 | FMKAVCVEVEK | 230 | 11 | 10 | 100 | | 2986 |
| SSP2 | FNRFLVGCH | 198 | 9 | 10 | 100 | | 2987 |
| SSP2 | FVVPGAATPY | 520 | 10 | 8 | 80 | 0.0002 | 2988 |
| SSP2 | GCHPSDGK | 204 | 8 | 10 | 100 | | 2989 |
| SSP2 | GDNFAVEK | 308 | 8 | 9 | 90 | | 2990 |
| SSP2 | GINVAFNR | 193 | 8 | 10 | 100 | | 2991 |
| SSP2 | GIPDSIQDSLK | 163 | 11 | 10 | 100 | | 2992 |
| SSP2 | GNRHVPNSEDR | 442 | 11 | 10 | 100 | | 2993 |
| SSP2 | GSIRRHNWVNH | 57 | 11 | 8 | 80 | | 2994 |
| SSP2 | GTRSRKREILH | 260 | 11 | 10 | 100 | | 2995 |
| SSP2 | HAVPLAMK | 67 | 8 | 10 | 100 | | 2996 |
| SSP2 | HDNQNNLPNDK | 401 | 11 | 10 | 100 | | 2997 |
| SSP2 | HGRNNENR | 457 | 8 | 10 | 100 | | 2998 |
| SSP2 | HGRNNENRSY | 457 | 10 | 10 | 100 | 0.0002 | 2999 |
| SSP2 | HLNDRINR | 143 | 8 | 10 | 100 | | 3000 |
| SSP2 | HSDASKNK | 104 | 8 | 10 | 100 | | 3001 |
| SSP2 | HSDASKNKEK | 104 | 10 | 10 | 100 | 0.0002 | 3002 |
| SSP2 | HVPNSEDR | 445 | 8 | 10 | 100 | | 3003 |
| SSP2 | HVPNSEDRETR | 445 | 11 | 9 | 90 | | 3004 |
| SSP2 | IFFDLFLVNGR | 16 | 11 | 10 | 100 | | 3005 |
| SSP2 | IGQGINVAFNR | 190 | 11 | 10 | 100 | | 3006 |
| SSP2 | IIRLHSDASK | 100 | 10 | 10 | 100 | 0.0002 | 3007 |
| SSP2 | IVDEIKYR | 32 | 8 | 9 | 90 | | 3008 |
| SSP2 | KAVCVEVEK | 232 | 9 | 10 | 100 | 0.0076 | 3009 |
| SSP2 | KDLDEPEQFR | 545 | 10 | 10 | 100 | | 3010 |
| SSP2 | KFVVPGAATPY | 519 | 11 | 8 | 80 | | 3011 |
| SSP2 | KGTRSRKR | 259 | 8 | 10 | 100 | | 3012 |
| SSP2 | KNVIGPFMK | 224 | 9 | 10 | 100 | | 3013 |
| SSP2 | KVLDNERK | 421 | 8 | 8 | 80 | | 3014 |
| SSP2 | LACAGLAY | 511 | 8 | 10 | 100 | | 3015 |
| SSP2 | LACAGLAYK | 511 | 9 | 10 | 100 | 0.0290 | 3016 |
| SSP2 | LALLACAGLAY | 508 | 11 | 10 | 100 | | 3017 |
| SSP2 | LDEPEQFR | 547 | 8 | 10 | 100 | | 3018 |
| SSP2 | LLACAGLAY | 510 | 9 | 10 | 100 | 0.0005 | 3019 |
| SSP2 | LLACAGLAYK | 510 | 10 | 10 | 100 | 0.0870 | 3020 |
| SSP2 | LLMDCSGSIR | 51 | 10 | 10 | 100 | 0.0005 | 3021 |
| SSP2 | LLMDCSGSIRR | 51 | 11 | 10 | 100 | | 3022 |
| SSP2 | LLQVRKHLNDR | 137 | 11 | 9 | 90 | | 3023 |
| SSP2 | LLSTNLPY | 121 | 8 | 9 | 90 | | 3024 |
| SSP2 | LLSTNLPYGR | 121 | 10 | 8 | 80 | 0.0025 | 3025 |
| SSP2 | LMDCSGSIR | 52 | 9 | 10 | 100 | 0.0002 | 3026 |
| SSP2 | LMDCSGSIRR | 52 | 10 | 10 | 100 | 0.0002 | 3027 |
| SSP2 | LMDCSGSIRRH | 52 | 11 | 10 | 100 | | 3028 |
| SSP2 | LSTNLPYGR | 122 | 9 | 8 | 80 | 0.0100 | 3029 |
| SSP2 | LVGCHPSDGK | 202 | 10 | 10 | 100 | 0.0002 | 3030 |
| SSP2 | MDCSGSIR | 53 | 8 | 10 | 100 | | 3031 |
| SSP2 | MDCSGSIRR | 53 | 9 | 10 | 100 | | 3032 |
| SSP2 | MDCSGSIRRH | 53 | 10 | 10 | 100 | | 3033 |
| SSP2 | MNHLGNVK | 1 | 8 | 10 | 100 | | 3034 |
| SSP2 | MNHLGNVKY | 1 | 9 | 10 | 100 | | 3035 |
| SSP2 | NFDIPKKPENK | 390 | 11 | 10 | 100 | | 3036 |
| SSP2 | NIPEDSEK | 366 | 8 | 10 | 100 | | 3037 |
| SSP2 | NIVDEIKY | 31 | 8 | 10 | 100 | | 3038 |
| SSP2 | NIVDEIKYR | 31 | 9 | 9 | 90 | 0.0002 | 3039 |
| SSP2 | NLPNDKSDR | 406 | 9 | 10 | 100 | 0.0002 | 3040 |
| SSP2 | NNENRSYNR | 460 | 9 | 10 | 100 | | 3041 |
| SSP2 | NNENRSYNRK | 460 | 10 | 10 | 100 | | 3042 |
| SSP2 | NNIVDEIK | 30 | 8 | 10 | 100 | | 3043 |
| SSP2 | NNIVDEIKY | 30 | 9 | 10 | 100 | | 3044 |
| SSP2 | NNIVDEIKYR | 30 | 10 | 9 | 90 | | 3045 |
| SSP2 | NNLPNDKSDR | 405 | 10 | 10 | 100 | | 3046 |
| SSP2 | NSEDRETR | 448 | 8 | 9 | 90 | | 3047 |
| SSP2 | NSEDRETRPH | 448 | 10 | 9 | 90 | 0.0002 | 3048 |
| SSP2 | NVIGPFMK | 225 | 8 | 10 | 100 | | 3049 |
| SSP2 | NVKNVIGPFMK | 222 | 11 | 10 | 100 | | 3050 |
| SSP2 | PCSVTCGK | 252 | 8 | 10 | 100 | | 3051 |
| SSP2 | PCSVTCGKGTR | 252 | 11 | 10 | 100 | | 3052 |
| SSP2 | PDSIQDSLK | 165 | 9 | 10 | 100 | 0.0002 | 3053 |
| SSP2 | PFDETLGEEDK | 535 | 11 | 10 | 100 | | 3054 |

TABLE XVII-continued

Malaria A11 Motif Peptides With Binding Information

| Protein | Sequence | Position | No. of Amino Acids | Sequence Frequency | Conservancy (%) | A*1101 | Seq. Id. |
|---|---|---|---|---|---|---|---|
| SSP2 | PNIPEDSEK | 365 | 9 | 10 | 100 | | 3055 |
| SSP2 | PNSEDRETR | 447 | 9 | 9 | 90 | | 3056 |
| SSP2 | PNSEDRETRPH | 447 | 11 | 9 | 90 | | 3057 |
| SSP2 | PSDGKCNLY | 207 | 9 | 10 | 100 | 0.0002 | 3058 |
| SSP2 | PSPNPEEGK | 328 | 9 | 10 | 100 | 0.0002 | 3059 |
| SSP2 | QCEEERCPPK | 280 | 10 | 8 | 80 | 0.0002 | 3060 |
| SSP2 | QDNNGNRH | 438 | 8 | 10 | 100 | | 3061 |
| SSP2 | QDSLKESR | 169 | 8 | 10 | 100 | | 3062 |
| SSP2 | QDSLKESRK | 169 | 9 | 9 | 90 | 0.0002 | 3063 |
| SSP2 | QGINVAFNR | 192 | 9 | 10 | 100 | 0.0780 | 3064 |
| SSP2 | QNNIVDEIK | 29 | 9 | 10 | 100 | | 3065 |
| SSP2 | QNNIVDEIKY | 29 | 10 | 10 | 100 | | 3066 |
| SSP2 | QNNIVDEIKYR | 29 | 11 | 9 | 90 | | 3067 |
| SSP2 | QNNLPNDK | 404 | 8 | 10 | 100 | | 3068 |
| SSP2 | QNNLPNDKSDR | 404 | 11 | 10 | 100 | | 3069 |
| SSP2 | QSQDNNGNR | 436 | 9 | 10 | 100 | 0.0002 | 3070 |
| SSP2 | QSQDNNGNRH | 436 | 10 | 10 | 100 | 0.0002 | 3071 |
| SSP2 | QVRKHLNDR | 139 | 9 | 9 | 90 | 0.0002 | 3072 |
| SSP2 | RGDNFAVEK | 307 | 9 | 9 | 90 | 0.0240 | 3073 |
| SSP2 | RLHSDASK | 102 | 8 | 10 | 100 | | 3074 |
| SSP2 | RLHSDASKNK | 102 | 10 | 10 | 100 | 0.0002 | 3075 |
| SSP2 | RNNENRSY | 459 | 8 | 10 | 100 | | 3076 |
| SSP2 | RNNENRSYNR | 459 | 10 | 10 | 100 | | 3077 |
| SSP2 | RNNENRSYNRK | 459 | 11 | 10 | 100 | | 3078 |
| SSP2 | RSRKREILH | 262 | 9 | 10 | 100 | 0.0002 | 3079 |
| SSP2 | SDASKNKEK | 105 | 9 | 10 | 100 | 0.0002 | 3080 |
| SSP2 | SDGKCNLY | 208 | 8 | 10 | 100 | | 3081 |
| SSP2 | SDVPKNPEDDR | 377 | 11 | 10 | 100 | | 3082 |
| SSP2 | SIQDSLKESR | 167 | 10 | 10 | 100 | 0.0009 | 3083 |
| SSP2 | SIQDSLKESRK | 167 | 11 | 9 | 90 | | 3084 |
| SSP2 | SIRRHNWVNH | 58 | 10 | 8 | 80 | 0.0002 | 3085 |
| SSP2 | SLLSTNLPY | 120 | 9 | 9 | 90 | 0.0046 | 3086 |
| SSP2 | SLLSTNLPYGR | 120 | 11 | 8 | 80 | | 3087 |
| SSP2 | STNLPYGR | 123 | 8 | 8 | 80 | | 3088 |
| SSP2 | SVTCGKGTR | 254 | 9 | 10 | 100 | 0.0009 | 3089 |
| SSP2 | SVTCGKGTRSR | 254 | 11 | 10 | 100 | | 3090 |
| SSP2 | TCGKGTRSR | 256 | 9 | 10 | 100 | | 3091 |
| SSP2 | TCGKGTRSRK | 256 | 10 | 10 | 100 | 0.0002 | 3092 |
| SSP2 | TCGKGTRSRKR | 256 | 11 | 10 | 100 | | 3093 |
| SSP2 | VAFNRFLVGCH | 196 | 11 | 10 | 100 | | 3094 |
| SSP2 | VCNDEVDLY | 42 | 9 | 8 | 80 | | 3095 |
| SSP2 | VGCHPSDGK | 203 | 9 | 10 | 100 | 0.0003 | 3096 |
| SSP2 | VNHAVPLAMK | 65 | 10 | 8 | 80 | | 3097 |
| SSP2 | VTCGKGTR | 255 | 8 | 10 | 100 | | 3098 |
| SSP2 | VTCGKGTRSR | 255 | 10 | 10 | 100 | 0.0017 | 3099 |
| SSP2 | VTCGKGTRSRK | 255 | 11 | 10 | 100 | | 3100 |
| SSP2 | VVPGAATPY | 521 | 9 | 8 | 80 | 0.0002 | 3101 |
| SSP2 | WSPCSVTCGK | 250 | 10 | 10 | 100 | 0.0002 | 3102 |
| SSP2 | WVNHAVPLAMK | 64 | 11 | 8 | 80 | | 3103 |
| SSP2 | YADSAWENVK | 215 | 10 | 10 | 100 | 0.0002 | 3104 |
| SSP2 | YLLMDCSGSIR | 50 | 11 | 10 | 100 | | 3105 |

TABLE XVIII

Malaria A24 Motif Peptides With Binding Information

| Protein | Sequence | Position | No. of Amino Acids | Sequence Frequency | Conservancy (%) | A*02401 | Seq. Id |
|---|---|---|---|---|---|---|---|
| CSP | CYGSSSNTRVL | 25 | 11 | 19 | 100 | | 3106 |
| CSP | DYENDIEKKI | 398 | 10 | 18 | 95 | | 3107 |
| CSP | EMNYYGKQENW | 52 | 11 | 19 | 100 | | 3108 |
| CSP | IMVLSFLF | 427 | 8 | 19 | 100 | | 3109 |
| CSP | IMVLSFLFL | 427 | 9 | 19 | 100 | 0.0008 | 3110 |
| CSP | KMEKCSSVF | 409 | 9 | 19 | 100 | | 3111 |
| CSP | MMRKLAIL | 1 | 8 | 19 | 100 | | 3112 |
| CSP | NYDNAGINL | 39 | 9 | 18 | 95 | 0.0004 | 3113 |
| CSP | NYYGKQENW | 54 | 9 | 19 | 100 | | 3114 |
| CSP | SFLFVEAL | 12 | 8 | 19 | 100 | | 3115 |
| CSP | SFLFVEALF | 12 | 9 | 19 | 100 | | 3116 |
| CSP | VFNVVNSSI | 416 | 9 | 19 | 100 | | 3117 |
| CSP | VFNVVNSSIGL | 416 | 11 | 19 | 100 | | 3118 |

TABLE XVIII-continued

Malaria A24 Motif Peptides With Binding Information

| Protein | Sequence | Position | No. of Amino Acids | Sequence Frequency | Conservancy (%) | A*02401 | Seq. Id |
|---|---|---|---|---|---|---|---|
| CSP | WYSLKKNSRSL | 62 | 11 | 19 | 100 | | 3119 |
| CSP | YYGKQENW | 55 | 8 | 19 | 100 | | 3120 |
| CSP | YYGKQENWYSL | 55 | 11 | 19 | 100 | | 3121 |
| EXP | DMIKKEEEL | 56 | 9 | 1 | 100 | | 3122 |
| EXP | FFIIFNKESL | 12 | 10 | 1 | 100 | | 3123 |
| EXP | FFLALFFI | 7 | 8 | 1 | 100 | | 3124 |
| EXP | FFLALFFII | 7 | 9 | 1 | 100 | | 3125 |
| EXP | FFLALFFIIF | 7 | 10 | 1 | 100 | | 3126 |
| EXP | KYKLATSVL | 73 | 9 | 1 | 100 | 0.0960 | 3127 |
| EXP | LFFIIFNKESL | 11 | 11 | 1 | 100 | | 3128 |
| EXP | LYNTEKGRHPF | 100 | 11 | 1 | 100 | | 3129 |
| EXP | VFFLALFF | 6 | 8 | 1 | 100 | | 3130 |
| EXP | VFFLALFFI | 6 | 9 | 1 | 100 | | 3131 |
| EXP | VFFLALFFII | 6 | 10 | 1 | 100 | | 3132 |
| EXP | VFFLALFFIIF | 6 | 11 | 1 | 100 | | 3133 |
| LSA | DFQISKYEDEI | 1754 | 11 | 1 | 100 | | 3134 |
| LSA | EFKPIVQYDNF | 1784 | 11 | 1 | 100 | | 3135 |
| LSA | FFDKDKEL | 77 | 8 | 1 | 100 | | 3136 |
| LSA | FYFILVNL | 9 | 8 | 1 | 100 | | 3137 |
| LSA | FYFILVNLL | 9 | 9 | 1 | 100 | 7.5000 | 3138 |
| LSA | FYFILVNLLI | 9 | 10 | 1 | 100 | | 3139 |
| LSA | FYFILVNLLIF | 9 | 11 | 1 | 100 | | 3140 |
| LSA | GYYIPHQSSL | 1670 | 10 | 1 | 100 | 0.0074 | 3141 |
| LSA | IFDGDNEI | 1884 | 8 | 1 | 100 | | 3142 |
| LSA | IFDGDNEIL | 1884 | 9 | 1 | 100 | | 3143 |
| LSA | IFDGDNEILQI | 1884 | 11 | 1 | 100 | | 3144 |
| LSA | IFHINGKI | 18 | 8 | 1 | 100 | | 3145 |
| LSA | IFHINGKII | 18 | 9 | 1 | 100 | | 3146 |
| LSA | IFLKENKL | 110 | 8 | 1 | 100 | | 3147 |
| LSA | IYKELEDL | 1802 | 8 | 1 | 100 | | 3148 |
| LSA | IYKELEDLI | 1802 | 9 | 1 | 100 | | 3149 |
| LSA | KFFDKDKEL | 76 | 9 | 1 | 100 | | 3150 |
| LSA | KFIKSLFHI | 1876 | 9 | 1 | 100 | | 3151 |
| LSA | KFIKSLFHIF | 1876 | 10 | 1 | 100 | | 3152 |
| LSA | KYEKTKDNNF | 1840 | 10 | 1 | 100 | 0.0004 | 3153 |
| LSA | LFHIFDGDNEI | 1881 | 11 | 1 | 100 | | 3154 |
| LSA | LYGRLEIPAI | 1652 | 10 | 1 | 100 | | 3155 |
| LSA | LYISFYFI | 5 | 8 | 1 | 100 | | 3156 |
| LSA | LYISFYFIL | 5 | 9 | 1 | 100 | 0.0088 | 3157 |
| LSA | NFKPNDKSL | 1848 | 9 | 1 | 100 | | 3158 |
| LSA | NFKSLLRNL | 96 | 9 | 1 | 100 | | 3159 |
| LSA | NFQDEENI | 1793 | 8 | 1 | 100 | | 3160 |
| LSA | NFQDEENIGI | 1793 | 10 | 1 | 100 | | 3161 |
| LSA | QYDNFQDEENI | 1790 | 11 | 1 | 100 | | 3162 |
| LSA | SFYFILVNL | 8 | 9 | 1 | 100 | | 3163 |
| LSA | SFYFILVNLL | 8 | 10 | 1 | 100 | | 3164 |
| LSA | SFYFILVNLLI | 8 | 11 | 1 | 100 | | 3165 |
| LSA | YFILVNLL | 10 | 8 | 1 | 100 | | 3166 |
| LSA | YFILVNLLI | 10 | 9 | 1 | 100 | | 3167 |
| LSA | YFILVNLLIF | 10 | 10 | 1 | 100 | | 3168 |
| LSA | YYIPHQSSL | 1671 | 9 | 1 | 100 | 4.3000 | 3169 |
| SSP2 | AMKLIQQL | 72 | 8 | 10 | 100 | | 3170 |
| SSP2 | AMKLIQQLNL | 72 | 10 | 10 | 100 | 0.0006 | 3171 |
| SSP2 | AWENVKNVI | 219 | 9 | 10 | 100 | | 3172 |
| SSP2 | KYKIAGGI | 497 | 8 | 9 | 90 | | 3173 |
| SSP2 | KYLVIVFL | 8 | 8 | 10 | 100 | | 3174 |
| SSP2 | KYLVIVFLI | 8 | 9 | 10 | 100 | 4.6000 | 3175 |
| SSP2 | KYLVIVFLIF | 8 | 10 | 10 | 100 | 0.0003 | 3176 |
| SSP2 | KYLVIVFLIFF | 8 | 11 | 10 | 100 | | 3177 |
| SSP2 | LMDCSGSI | 52 | 8 | 10 | 100 | | 3178 |
| SSP2 | LYLLMDCSGSI | 49 | 11 | 9 | 90 | | 3179 |
| SSP2 | NWVNHAVPL | 63 | 9 | 8 | 80 | | 3180 |
| SSP2 | PYAGEPAPF | 528 | 9 | 8 | 80 | 0.0370 | 3181 |
| SSP2 | QFRLPEENEW | 552 | 10 | 10 | 100 | | 3182 |
| SSP2 | VFGIGQGI | 187 | 8 | 10 | 100 | | 3183 |
| SSP2 | VFLIFFDL | 13 | 8 | 10 | 100 | | 3184 |
| SSP2 | VFLIFFDLF | 13 | 9 | 10 | 100 | | 3185 |
| SSP2 | VFLIFFDLFL | 13 | 10 | 10 | 100 | | 3186 |

TABLE XIXa

Malaria DR Super Motif Peptide

| Protein | Core Sequence | Core SeqID Num | Core Frequency | Core Conservancy (%) | Exemplary Sequence | Exemplary SeqID Num | Position In PF Poly-Protein | Exemplary Sequence Frequency | Exemplary Sequence Conservancy (%) |
|---|---|---|---|---|---|---|---|---|---|
| CSP | FLFVEALFQ | 3187 | 19 | 100 | VSSFLFVEALFQEYQ | 3291 | 10 | 19 | 100 |
| CSP | FNVVNSSIG | 3188 | 19 | 100 | SSVFNVVNSSIGLIM | 3292 | 440 | 19 | 100 |
| CSP | FQEYQCYGS | 3189 | 19 | 100 | EALFQEYQCYGSSSN | 3293 | 17 | 19 | 100 |
| CSP | IEKKICKME | 3190 | 19 | 100 | ENDIEKKICKMEKCS | 3294 | 426 | 19 | 100 |
| CSP | IGLIMVLSF | 3191 | 19 | 100 | NSSIGLIMVLSFLFL | 3295 | 447 | 19 | 100 |
| CSP | ILSVSSFLF | 3192 | 19 | 100 | KLAILSVSSFLFVEA | 3296 | 4 | 19 | 100 |
| CSP | LAILSVSSF | 3193 | 19 | 100 | MRKLAILSVSSFLFV | 3297 | 2 | 19 | 100 |
| CSP | MEKCSSVFN | 3194 | 19 | 100 | ICKMEKCSSVFNVVN | 3298 | 433 | 19 | 100 |
| CSP | VVNSSIGLI | 3195 | 19 | 100 | VFNVVNSSIGLIMVL | 3299 | 442 | 19 | 100 |
| CSP | YQCYGSSSN | 3196 | 19 | 100 | FQEYQCYGSSSNTRV | 3300 | 20 | 19 | 100 |
| CSP | YNELEMNYY | 3197 | 19 | 100 | INLYNELEMNYYGKQ | 3301 | 45 | 18 | 95 |
| CSP | YDNAGINLY | 3198 | 18 | 95 | ELNYDNAGINLYNEL | 3302 | 37 | 18 | 95 |
| CSP | IQNSLSTEW | 3199 | 15 | 79 | LKKIQNSLSTEWSPC | 3303 | 385 | 15 | 79 |
| CSP | WSPCSVTCG | 3200 | 10 | 100 | STEWSPCSVTCGNGI | 3304 | 393 | 19 | 100 |
| LSA | FILVNLLIF | 3201 | 1 | 100 | SFYFILVNLLIFHIN | 3305 | 8 | 1 | 100 |
| LSA | FYFILVNLL | 3202 | 1 | 100 | YISFYFILVNLLIFH | 3306 | 6 | 1 | 100 |
| LSA | IHKGHLEEK | 3203 | 1 | 100 | RRDIHKGHLEEKKDG | 3307 | 1711 | 1 | 100 |
| LSA | IIKSNLRSG | 3204 | 1 | 100 | KDEIIKSNLRSGSSN | 3308 | 31 | 1 | 100 |
| LSA | ILVNLLIFH | 3205 | 1 | 100 | FYFILVNLLIFHING | 3309 | 9 | 1 | 100 |
| LSA | INGKIIKNS | 3206 | 1 | 100 | IFHINGKIIKNSEKD | 3310 | 18 | 1 | 100 |
| LSA | IPAIELPSE | 3207 | 1 | 100 | RLEIPAIELPSENER | 3311 | 1655 | 1 | 100 |
| LSA | IPHQSSLPQ | 3208 | 1 | 100 | GYYIPHQSSLPQDNR | 3312 | 1670 | 1 | 100 |
| LSA | IQNHTLETV | 3209 | 1 | 100 | SADIQNHTLETVNIS | 3313 | 1736 | 1 | 100 |
| LSA | ISFYFILVN | 3210 | 1 | 100 | ILYISFYFILVNLLI | 3314 | 4 | 1 | 100 |
| LSA | LDEFKPIVQ | 3211 | 1 | 100 | DEDLDEFKPIVQYDN | 3315 | 1779 | 1 | 100 |
| LSA | LEEKAAKET | 3212 | 1 | 100 | QEDLEEKAAKETLQG | 3316 | 146 | 1 | 100 |
| LSA | LEIPAIELP | 3213 | 1 | 100 | YGRLEIPAIELPSEN | 3317 | 1653 | 1 | 100 |
| LSA | LEQRKADTK | 3214 | 1 | 100 | QRDLEQRKADTKKNL | 3318 | 1624 | 1 | 100 |
| LSA | LERTKASKE | 3215 | 1 | 100 | QSDLERTKASKETLQ | 3319 | 1182 | 1 | 100 |
| LSA | LETVNISDV | 3216 | 1 | 100 | NHTLETVNISDVNDF | 3320 | 1741 | 1 | 100 |
| LSA | LIEHIINDD | 3217 | 1 | 100 | EGKLIEHIINDDDDK | 3321 | 120 | 1 | 100 |
| LSA | LKENKLNKE | 3218 | 1 | 100 | NIFLKENKLNKEGKL | 3322 | 109 | 1 | 100 |
| LSA | LLIFHINGK | 3219 | 1 | 100 | LVNLLIFHINGKIIK | 3323 | 13 | 1 | 100 |
| LSA | LQEQQSDLE | 3220 | 1 | 100 | KETLQEQQSDLEQER | 3324 | 1192 | 1 | 100 |
| LSA | LQEQQSDSE | 3221 | 1 | 100 | KEKLQEQQSDSEQER | 3325 | 512 | 1 | 100 |
| LSA | LQGQQSDLE | 3222 | 1 | 100 | KETLQGQQSDLEQER | 3326 | 155 | 1 | 100 |
| LSA | LRNLGVSEN | 3223 | 1 | 100 | KSLLRNLGVSENIFL | 3327 | 98 | 1 | 100 |
| LSA | LRSGSSNSR | 3224 | 1 | 100 | KSNLRSGSSNSRNRI | 3328 | 36 | 1 | 100 |
| LSA | LTMSNVKNV | 3225 | 1 | 100 | DKELTMSNVKNVSQT | 3329 | 81 | 1 | 100 |
| LSA | LVNLLIFHI | 3226 | 1 | 100 | YFILVNLLIFHINGK | 3330 | 10 | 1 | 100 |
| LSA | VLSHNSYEK | 3227 | 1 | 100 | KKHVLSHNSYEKTKN | 3331 | 57 | 1 | 100 |
| LSA | VNDFQISKY | 3228 | 1 | 100 | ISDVNDFQISKYEDE | 3332 | 1749 | 1 | 100 |
| LSA | VNISDVNDF | 3229 | 1 | 100 | LETVNISDVNDFQIS | 3333 | 1744 | 1 | 100 |
| LSA | YDDSLIDEE | 3230 | 1 | 100 | SAEYDDSLIDEEEDD | 3334 | 1765 | 1 | 100 |
| LSA | YGRLEIPAI | 3231 | 1 | 100 | EDLYGRLEIPAIELP | 3335 | 1650 | 1 | 100 |
| LSA | YIPHQSSLP | 3232 | 1 | 100 | RGYYIPHQSSLPQDN | 3336 | 1669 | 1 | 100 |
| EXP | FKIGSSDPA | 3233 | 1 | 100 | RHPFKIGSSDPADNA | 3337 | 107 | 1 | 100 |
| EXP | IDVHDLISD | 3234 | 1 | 100 | EPLIDVHDLISDMIK | 3338 | 45 | 1 | 100 |
| EXP | IFNKESLAE | 3235 | 1 | 100 | FFIIFNKESLAEKTN | 3339 | 12 | 1 | 100 |
| EXP | IGSSDPADN | 3236 | 1 | 100 | PFKIGSSDPADNANP | 3340 | 109 | 1 | 100 |
| EXP | LALFFIIFN | 3237 | 1 | 100 | VFFLALFFIIFNKES | 3341 | 6 | 1 | 100 |
| EXP | LATSVLAGL | 3238 | 1 | 100 | KYKLATSVLAGLLGN | 3342 | 73 | 1 | 100 |
| EXP | LGGVGLVLY | 3239 | 1 | 100 | TVLLGGVGLVLYNTE | 3343 | 90 | 1 | 100 |
| EXP | LGNVSTVLL | 3240 | 1 | 100 | AGLLGNVSTVLLGGV | 3344 | 82 | 1 | 100 |
| EXP | LLGNVSTVL | 3241 | 1 | 100 | LAGLLGNVSTVLLGG | 3345 | 81 | 1 | 100 |
| EXP | LSVFFLALF | 3242 | 1 | 100 | MKILSVFFLALFFII | 3346 | 1 | 1 | 100 |
| EXP | LVLYNTEKG | 3243 | 1 | 100 | GVGLVLYNTEKGRHP | 3347 | 95 | 1 | 100 |
| EXP | VFFLALFFI | 3244 | 1 | 100 | ILSVFFLALFFIIFN | 3348 | 3 | 1 | 100 |
| EXP | VHDLISDMI | 3245 | 1 | 100 | LIDVHDLISDMIKKE | 3349 | 47 | 1 | 100 |
| EXP | VLAGLLGNV | 3246 | 1 | 100 | ATSVLAGLLGNVSTV | 3350 | 77 | 1 | 100 |
| EXP | VLLGGVGLV | 3247 | 1 | 100 | VSTVLLGGVGLVLYN | 3351 | 88 | 1 | 100 |
| EXP | VNKRKSKYK | 3248 | 1 | 100 | LVEVNKRKSKYKLAT | 3352 | 64 | 1 | 100 |
| EXP | VSTVLLGGV | 3249 | 1 | 100 | LGNVSTVLLGGVGLV | 3353 | 85 | 1 | 100 |
| EXP | VTAQDVTPE | 3250 | 1 | 100 | DPQVTAQDVTPEQPQ | 3574 | 136 | 1 | 100 |
| EXP | YKLATSVLA | 3251 | 1 | 100 | KSKYKLATSVLAGLL | 3354 | 71 | 1 | 100 |
| SSP2 | FDLFLVNGR | 3252 | 10 | 100 | LIFFDLFLVNGRDVQ | 3355 | 15 | 10 | 100 |
| SSP2 | FFDLFLVNG | 3253 | 10 | 100 | FLIFFDLFLVNGRDV | 3356 | 14 | 10 | 100 |
| SSP2 | FMKAVCVEV | 3254 | 10 | 100 | IGPFMKAVCVEVEKT | 3357 | 227 | 10 | 100 |
| SSP2 | FNRFLVGCH | 3255 | 10 | 100 | NVAFNRFLVGCHPSD | 3358 | 195 | 10 | 100 |
| SSP2 | IAGGLALLA | 3256 | 10 | 100 | AGGIAGGLALLACAG | 3359 | 513 | 10 | 100 |
| SSP2 | IAVFGIGQG | 3257 | 10 | 100 | GVKIAVFGIGQGNIV | 3360 | 182 | 10 | 100 |
| SSP2 | LACAGLAYK | 3258 | 10 | 100 | LALLACAGLAYKFVV | 3361 | 520 | 10 | 100 |
| SSP2 | LALLACAGL | 3259 | 10 | 100 | AGGLALLACAGLAYK | 3362 | 517 | 10 | 100 |
| SSP2 | LAMKLIQQL | 3260 | 10 | 100 | AVPLAMKLIQQLNLN | 3363 | 68 | 10 | 100 |

TABLE XIXa-continued

Malaria DR Super Motif Peptide

| Protein | Core Sequence | Core SeqID Num | Core Frequency | Core Conservancy (%) | Exemplary Sequence | Exemplary SeqID Num | Position In PF Poly-Protein | Exemplary Sequence Frequency | Exemplary Sequence Conservancy (%) |
|---|---|---|---|---|---|---|---|---|---|
| SSP2 | LAYKFVVPG | 3261 | 10 | 100 | CAGLAYKFVVPGAAT | 3364 | 525 | 10 | 100 |
| SSP2 | LIFFDLFLV | 3262 | 10 | 100 | IVFLIFFDLFLVNGR | 3365 | 12 | 10 | 100 |
| SSP2 | LTDGIPDSI | 3263 | 10 | 100 | VVILTDGIPDSIQDS | 3366 | 157 | 10 | 100 |
| SSP2 | LVGCHPSDG | 3264 | 10 | 100 | NRFLVGCHPSDGKCN | 3367 | 199 | 10 | 100 |
| SSP2 | LVIVFLIFF | 3265 | 10 | 100 | VKYLVIVFLIFFDLF | 3368 | 7 | 10 | 100 |
| SSP2 | LVVILTDGI | 3266 | 10 | 100 | ANQLVVILTDGIPDS | 3369 | 153 | 10 | 100 |
| SSP2 | MDCSGSIRR | 3267 | 10 | 100 | YLLMDCSGSIRRHNW | 3370 | 50 | 10 | 100 |
| SSP2 | MKAVCVEVE | 3268 | 10 | 100 | GPFMKAVCVEVEKTA | 3371 | 228 | 10 | 100 |
| SSP2 | VEKTASCGV | 3269 | 10 | 100 | CVEVEKTASCGVWDE | 3372 | 235 | 10 | 100 |
| SSP2 | VGCHPSDGK | 3270 | 10 | 100 | RFLVGCHPSDGKCNL | 3373 | 200 | 10 | 100 |
| SSP2 | VIGPFMKAV | 3271 | 10 | 100 | VKNVIGPFMKAVCVE | 3374 | 223 | 10 | 100 |
| SSP2 | VIVFLIFFD | 3272 | 10 | 100 | KYLVIVFLIFFDLFL | 3375 | 8 | 10 | 100 |
| SSP2 | VKYLVTVFL | 3273 | 10 | 100 | LGNVKYLVTVFLIFF | 3376 | 4 | 10 | 100 |
| SSP2 | VNGRDVQNN | 3274 | 10 | 100 | LFLVNGRDVQNNIVD | 3377 | 20 | 10 | 100 |
| SSP2 | WDEWSPCSV | 3275 | 10 | 100 | CGVWDEWSPCSVTCG | 3378 | 244 | 10 | 100 |
| SSP2 | IAGGIAGGL | 3276 | 10 | 100 | KYKIAGGIAGGLALL | 3379 | 509 | 9 | 90 |
| SSP2 | VQNNIVDEI | 3277 | 10 | 100 | GRDVQNNIVDEIKYR | 3380 | 25 | 9 | 90 |
| SSP2 | YLLMDCSGS | 3278 | 10 | 100 | VDLYLLMDCSGSIRR | 3381 | 47 | 9 | 90 |
| SSP2 | FVVPGAATP | 3279 | 10 | 100 | AYKFVVPGAATPYAG | 3382 | 529 | 8 | 80 |
| SSP2 | YKFVVPGAA | 3280 | 10 | 100 | GLAYKFVVPGAATPY | 3383 | 527 | 8 | 80 |
| SSP2 | IIRLHSDAS | 3281 | 10 | 100 | AKEIIRLHSDASKNK | 3384 | 97 | 6 | 60 |
| SSP2 | IIDNNPQEP | 3282 | 10 | 100 | EENIIDNNPQEPSPN | 3385 | 317 | 4 | 40 |
| SSP2 | VDLYLLMDC | 3283 | 9 | 90 | NDEVDLYLLMDCSGS | 3386 | 44 | 8 | 80 |
| SSP2 | LLSTNLPYG | 3284 | 9 | 90 | IKSLLSTNLPYGRTN | 3387 | 118 | 5 | 50 |
| SSP2 | LHEGCTSEL | 3285 | 8 | 80 | REILHEGCTSELQEQ | 3388 | 266 | 8 | 80 |
| SSP2 | VNHAVPLAM | 3286 | 8 | 80 | HNWVNHAVPLAMKLI | 3389 | 62 | 8 | 80 |
| SSP2 | VPGAATPYA | 3287 | 8 | 80 | KFVVPGAATPYAGEP | 3390 | 531 | 8 | 80 |
| SSP2 | VVPGAATPY | 3288 | 8 | 80 | YKFVVPGAATPYAGE | 3391 | 530 | 8 | 80 |
| SSP2 | WVNHAVPLA | 3289 | 8 | 80 | RHNWVNHAVPLAMKL | 3392 | 61 | 8 | 80 |
| SSP2 | LSTNLPYGR | 3290 | 8 | 80 | KSLLSTNLPYGRTNL | 3393 | 119 | 5 | 50 |

TABLE XIXb

Malaria DR Super Motif Peptide With Binding Data

| Core Sequence | Core SeqID Num | Exemplary Sequence | Exemplary SeqID Num | DR 1 | DR2w2β1 | DR2w2β2 | DR3 | DR4w4 | DR4w15 | DR5w11 |
|---|---|---|---|---|---|---|---|---|---|---|
| FLFVEALFQ | 3187 | VSSFLFVEALFQEYQ | 3291 | | | | | | | |
| FNVVNSSIG | 3188 | SSVFNVVNSSIGLIM | 3292 | 0.1200 | 0.0290 | 0.0080 | −0.0043 | 0.1000 | 0.0230 | 0.0170 |
| FQEYQCYGS | 3189 | EALFQEYQCYGSSSN | 3293 | 0.0001 | | −0.0005 | | 0.0053 | −0.0009 | −0.0002 |
| IEKKICKME | 3190 | ENDIEKKICKMEKCS | 3294 | | | | | | | |
| IGLIMVLSF | 3191 | NSSIGLIMVLSFLFL | 3295 | 0.0040 | 0.0250 | 0.0024 | −0.0043 | 0.0120 | 0.0035 | −0.0005 |
| ILSVSSFLF | 3192 | KLAILSVSSFLFVEA | 3296 | | | | | | | |
| LAILSVSSF | 3193 | MRKLAILSVSSFLFV | 3297 | 0.1000 | 0.5000 | 0.0130 | −0.0043 | 0.0078 | 0.0270 | 0.0370 |
| MEKCSSVFN | 3194 | ICKMEKCSSVFNVVN | 3298 | | | | | | | |
| VVNSSIGLI | 3195 | VFNVVNSSIGLIMVL | 3299 | 0.0310 | 0.0021 | 0.0006 | 0.0021 | 0.0079 | 0.0056 | 0.0002 |
| YQCYGSSSN | 3196 | FQEYQCYGSSSNTRV | 3300 | | | | | | | |
| YNELEMNYY | 3197 | INLYNELEMNYYGKQ | 3301 | | | | | | | |
| YDNAGINLY | 3198 | ELNYDNAGINLYNEL | 3302 | 0.0003 | | −0.0005 | 0.0091 | −0.0009 | −0.0009 | −0.0002 |
| IQNSLSTEW | 3199 | LKKIQNSLSTEWSPC | 3303 | | | | | | | |
| WSPCSVTCG | 3200 | STEWSPCSVTCGNGI | 3304 | | | | | | | |
| FILVNLLIF | 3201 | SFYFILVNLLIFHIN | 3305 | 0.0009 | 0.0100 | −0.0020 | −0.0043 | 0.0250 | 0.0038 | −0.0005 |
| FYFILVNLL | 3202 | YISFYFILVNLLIFH | 3306 | 0.0029 | 0.0040 | 0.0044 | −0.0008 | 0.0210 | −0.0009 | 0.0011 |
| IHKGHLEEK | 3203 | RRDIHKGHLEEKKDG | 3307 | | | | | | | |
| IIKSNLRSG | 3204 | KDEIIKSNLRSGSSN | 3308 | | | | | | | |
| ILVNLLIFH | 3205 | FYFILVNLLIFHING | 3309 | | | | | | | |
| INGKIIKNS | 3206 | IFHINGKIIKNSEKD | 3310 | 0.0320 | 0.0220 | 0.0660 | 0.0120 | −0.0007 | 0.0038 | 0.0380 |
| IPAIELPSE | 3207 | RLEIPAIELPSENER | 3311 | | | | | | | |
| IPHQSSLPQ | 3208 | GYYIPHQSSLPQDNR | 3312 | | | | | | | |
| IQNHTLETV | 3209 | SADIQNHTLETVNIS | 3313 | 0.0001 | | −0.0005 | −0.0041 | −0.0007 | −0.0014 | −0.0002 |
| ISFYFILVN | 3210 | ILYISFYFILVNLLI | 3314 | | | | | | | |
| LDEFKPIVQ | 3211 | DEDLDEFKPIVQYDN | 3315 | | | | | | | |
| LEEKAAKET | 3212 | QEDLEEKAAKETQG | 3316 | 0.0001 | | −0.0005 | | −0.0009 | −0.0009 | −0.0002 |
| LEIPAIELP | 3213 | YGRLEIPAIELPSEN | 3317 | | | | | | | |
| LEQRKADTK | 3214 | QRDLEQRKADTKKNL | 3318 | | | | | | | |
| LERTKASKE | 3215 | QSDLERTKASKETLQ | 3319 | | | | | | | |

TABLE XIXb-continued

Malaria DR Super Motif Peptide With Binding Data

| | | | | | | | | | | |
|---|---|---|---|---|---|---|---|---|---|---|
| LETVNISDV | 3216 | NHTLETVNISDVNDF | 3320 | 0.0001 | | −0.0005 | | −0.0007 | 0.0016 | −0.0002 |
| LIEHIINDD | 3217 | EGKLIEHIINDDDDK | 3321 | | | | | | | |
| LKENKLNKE | 3218 | NIFLKENKLNKEGKL | 3322 | | | | | | | |
| LLIFHINGK | 3219 | LVNLLIFHINGKIIK | 3323 | 0.0640 | 0.7100 | 0.0070 | −0.0043 | 0.0110 | −0.0030 | 0.2700 |
| LQEQQSDLE | 3220 | KETLQEQQSDLEQER | 3324 | | | | | | | |
| LQEQQSDSE | 3221 | KEKLQEQQSDSEQER | 3325 | | | | | | | |
| LQGQQSDLE | 3222 | KETLQEQQSDLEQER | 3326 | | | | | | | |
| LRNLGVSEN | 3223 | KSLLRNLGVSENIFL | 3327 | 0.0150 | 0.0088 | 0.0006 | | 0.0210 | 0.0810 | 0.0033 |
| LRSGSSNSR | 3224 | KSNLRSGSSNSRNRI | 3328 | | | | | | | |
| LTMSNVKNV | 3225 | DKELTMSNVKNVSQT | 3329 | 0.0018 | 0.0003 | 0.0009 | 0.0058 | 0.0023 | 0.0074 | 0.0030 |
| LVNLLIFHI | 3226 | YFILVNLLIFHINGK | 3330 | 0.0018 | 0.0004 | 0.0120 | −0.0008 | 0.0160 | 0.0027 | 0.0015 |
| VLSHNSYEK | 3227 | KKHVLSHNSYEKTKN | 3331 | | | | | | | |
| VNDFQISKY | 3228 | ISDVNDFQISKYEDE | 3332 | 0.0001 | | −0.0005 | | −0.0007 | −0.0014 | −0.0002 |
| VNISDVNDF | 3229 | LETVNISDVNDFQIS | 3333 | | | | | | | |
| YDDSLIDEE | 3230 | SAEYDDSLIDEEEDD | 3334 | | | | | | | |
| YGRLEIPAI | 3231 | EDLYGRLEIPAIELP | 3335 | 0.0004 | | −0.0005 | | −0.0007 | −0.0170 | −0.0002 |
| YIPHQSSLP | 3232 | RGYYIPHQSSLPQDN | 3336 | 0.2900 | 0.0004 | 0.0029 | | 4.1000 | 0.2800 | 0.0064 |
| FKIGSSDPA | 3233 | RHPFKIGSSDPADNA | 3337 | 0.0044 | −0.0004 | −0.0005 | −0.0008 | 0.4700 | 0.0029 | 0.0056 |
| IDVHDLISD | 3234 | EPLIDVHDLISDMIK | 3338 | | | | | | | |
| IFNKESLAE | 3235 | FFIIFNKESLAEKTN | 3339 | | | | | | | |
| IGSSDPADN | 3236 | PFKIGSSDPADNANP | 3340 | | | | | | | |
| LALFFIIFN | 3237 | VFFLALFFIIFNKES | 3341 | 0.0006 | 0.0180 | −0.0021 | −0.0043 | 0.0047 | 0.0100 | −0.0005 |
| LATSVLAGL | 3238 | KYKLATSVLAGLLGN | 3342 | 1.2000 | 0.0018 | 0.0700 | 0.0010 | 3.2000 | 0.1200 | 0.0210 |
| LGGVGLVLY | 3239 | TVLLGGVGLVLYNTE | 3343 | 0.4900 | | −0.0005 | | 0.0032 | −0.0009 | −0.0002 |
| LGNVSTVLL | 3240 | AGLLGNVSTVLLGGV | 3344 | 0.0430 | 0.0240 | 0.0013 | 0.0069 | 0.0065 | 0.0360 | 0.0005 |
| LLGNVSTVL | 3241 | LAGLLGNVSTVLLGG | 3345 | 0.0420 | 0.0110 | 0.0006 | 0.0078 | 0.0160 | 0.0230 | 0.0004 |
| LSVFFLALF | 3242 | MKILSVFFLALFFII | 3346 | 0.0017 | 0.0170 | −0.0021 | −0.0043 | 0.0370 | −0.0047 | −0.0010 |
| LVLYNTEKG | 3243 | GVGLVLYNTEKGRHP | 3347 | | | | | | | |
| VFFLALFFI | 3244 | ILSVFFLALFFIIFN | 3348 | 0.0016 | 0.0036 | 0.0091 | −0.0008 | 0.0130 | −0.0009 | 0.0012 |
| VHDLISDMI | 3245 | LIDVHDLISDMIKKE | 3349 | 0.0130 | | 0.0061 | 0.0100 | 0.0310 | 0.0076 | 0.0037 |
| VLAGLLGNV | 3246 | ATSVLAGLLGNVSTV | 3350 | 0.2600 | | −0.0005 | | 0.0021 | −0.0014 | 0.0008 |
| VLLGGVGLV | 3247 | VSTVLLGGVGLVLYN | 3351 | 0.8800 | 0.0080 | 0.0005 | −0.0008 | 0.0067 | −0.0009 | 0.0003 |
| VNKRKSKYK | 3248 | LVEVNKRKSKYKLAT | 3352 | | | | | | | |
| VSTVLLGGV | 3249 | LGNVSTVLLGGVGLV | 3353 | 0.0140 | 0.0001 | −0.0005 | −0.0008 | 0.0016 | −0.0014 | −0.0002 |
| VTAQDVTPE | 3250 | DPQVTAQDVTPEQPQ | 3574 | | | | | | | |
| YKLATSVLA | 3251 | KSKYKLATSVLAGLL | 3354 | 1.4000 | 0.0073 | 0.8500 | −0.0008 | 6.3000 | 0.8100 | 0.6700 |
| FDLFLVNGR | 3252 | LIFFDLFLVNGRDVQ | 3355 | 0.0042 | | | | 0.0036 | | |
| FFDLFLVNG | 3253 | FLIFFDLFLVNGRDV | 3356 | | | | | | | |
| FMKAVCVEV | 3254 | IGPFMKAVCVEVEKT | 3357 | 0.0072 | 0.0003 | 0.0430 | −0.0008 | −0.0006 | 0.0086 | −0.0004 |
| FNRFLVGCH | 3255 | NVAFNRFLVGCHPSD | 3358 | | | | | | | |
| IAGGLALLA | 3256 | AGGIAGGLALLACAG | 3359 | 0.0160 | | 0.0013 | | 0.0014 | −0.0014 | −0.0002 |
| IAVFGIGQG | 3257 | GVKIAVFGIGQGINV | 3360 | | | | | | | |
| LACAGLAYK | 3258 | LALLACAGLAYKFVV | 3361 | | | | | | | |
| LALLACAGL | 3259 | AGGLALLACAGLAYK | 3362 | 0.0018 | | 0.0013 | | −0.0007 | −0.0014 | −0.0002 |
| LAMKLIQQL | 3260 | AVPLAMKLIQQLNLN | 3363 | 0.0015 | | −0.0006 | | 0.0023 | 0.0013 | 0.0002 |
| LAYKFVVPG | 3261 | CAGLAYKFVVPGAAT | 3364 | | 0.0048 | | | | | |
| LIFFDLFLV | 3262 | IVFLIFFDLFLVNGR | 3365 | 0.0006 | | 0.0019 | −0.0008 | 0.0130 | −0.0009 | 0.0019 |
| LTDGIPDSI | 3263 | VVILTDGIPDSIQDS | 3366 | 0.0001 | | −0.0006 | | 0.1200 | −0.0014 | −0.0004 |
| LVGCHPSDG | 3264 | NRFLVGCHPSDGKCN | 3367 | | | | | | | |
| LVIVFLIFF | 3265 | VKYLVIVFLIFFDLF | 3368 | 0.0001 | | | | 0.0030 | | |
| LVVILTDGI | 3266 | ANQLVVILTDGIPDS | 3369 | 0.0038 | 0.0008 | −0.0005 | 0.0019 | 0.0460 | 0.0062 | −0.0002 |
| MDCSGSIRR | 3267 | YLLMDCSGSIRRHNW | 3370 | | | | | | | |
| MKAVCVEVE | 3268 | GPFMKAVCVEVEKTA | 3371 | | | | | | | |
| VEKTASCGV | 3269 | CVEVEKTASCGVWDE | 3372 | 0.0004 | | −0.0005 | | 0.0021 | −0.0009 | −0.0002 |
| VGCHPSDGK | 3270 | RFLVGCHPSDGKCNL | 3373 | | | | | | | |
| VIGPFMKAV | 3271 | VKNVIGPFMKAVCVE | 3374 | 0.0900 | 0.0430 | 0.0800 | −0.0026 | −0.0020 | −0.0030 | 0.3420 |
| VIVFLIFFD | 3272 | KYLVIVFLIFFDLFL | 3375 | 0.0012 | 0.0057 | −0.0020 | −0.0043 | 0.0680 | −0.0030 | −0.0009 |
| VKYLVTVFL | 3273 | LGNVKYLVTVFLIFF | 3376 | 0.0006 | 0.0033 | 0.0012 | −0.0008 | 0.0120 | 0.0045 | 0.0018 |
| VNGRDVQNN | 3274 | LFLVNGRDVQNNIVD | 3377 | | | | | | | |
| WDEWSPCSV | 3275 | CGVWDEWSPCSVTCG | 3378 | 0.0001 | | −0.0006 | | −0.0007 | −0.0014 | −0.0002 |
| IAGGIAGGL | 3276 | KYKIAGGIAGGLALL | 3379 | 0.0380 | 0.0001 | 0.0480 | 0.0250 | 0.0120 | 0.0017 | 0.2300 |
| VQNNIVDEI | 3277 | GRDVQNNIVDEIKYR | 3380 | 0.0001 | 0.0001 | −0.0006 | 0.0026 | −0.0006 | −0.0014 | −0.0004 |
| YLLMDCSGS | 3278 | VDLYLLMDCSGSIRR | 3381 | 0.0016 | | 0.0096 | | 0.0150 | −0.0014 | −0.0004 |
| FVVPGAATP | 3279 | AYKFVVPGAATPYAG | 3382 | 0.3600 | −0.0009 | 0.0620 | 0.0160 | 0.1600 | 0.0036 | 0.6400 |
| YKFVVPGAA | 3280 | GLAYKFVVPGAATPY | 3383 | 1.6000 | 0.0001 | 0.7000 | −0.0008 | 1.0000 | 0.0270 | 1.9000 |
| IIRLHSDAS | 3281 | AKEIIRLHSDASKNK | 3384 | | | | | | | |
| IIDNNPQEP | 3282 | EENIIDNNPQEPSPN | 3385 | | | | | | | |
| VDLYLLMDC | 3283 | NDEVDLYLLMDCSGS | 3386 | 0.0001 | | −0.0005 | | 0.0028 | −0.0009 | −0.0002 |
| LLSTNLPYG | 3284 | IKSLLSTNLPYGRTN | 3387 | | | | | | | |
| LHEGCTSEL | 3285 | REILHEGCTSELQEQ | 3388 | 0.0001 | | −0.0005 | −0.0041 | −0.0009 | −0.0014 | −0.0002 |
| VNHAVPLAM | 3286 | HNWVNHAVPLAMKLI | 3389 | 0.3500 | 0.0250 | 0.1400 | 0.2300 | 3.9000 | 0.0400 | 0.0074 |
| VPGAATPYA | 3287 | KFVVPGAATPYAGEP | 3390 | 0.0230 | 0.0001 | 0.0010 | 0.0620 | 0.1200 | 0.0067 | 0.0010 |
| VVPGAATPY | 3288 | YKFVVPGAATPYAGE | 3391 | 0.1100 | 0.0008 | 0.0053 | −0.0008 | 0.0057 | −0.0014 | 0.0036 |
| WVNHAVPLA | 3289 | RHNWVNHAVPLAMKL | 3392 | 0.1900 | 0.0350 | 0.1600 | 0.4000 | 5.0000 | 0.0360 | 0.0079 |
| LSTNLPYGR | 3290 | KSLLSTNLPYGRTNL | 3393 | 0.0012 | | | | 0.0120 | | |

TABLE XIXb-continued

Malaria DR Super Motif Peptide With Binding Data

| Core Sequence | Core SeqID Num | Exemplary Sequence | Exemplary SeqID Num | DR5w12 | DR6w19 | DR7 | DR8w2 | DR9 | DRw53 |
|---|---|---|---|---|---|---|---|---|---|
| FLFVEALFQ | 3187 | VSSFLFVEALFQEYQ | 3291 | | 0.3600 | 0.7600 | 0.0550 | 1.2000 | |
| FNVVNSSIG | 3188 | SSVFNVVNSSIGLIM | 3292 | 0.0051 | | −0.0003 | 0.0005 | | |
| FQEYQCYGS | 3189 | EALFQEYQCYGSSSN | 3293 | 0.0001 | | | | | |
| IEKKICKME | 3190 | ENDIEKKICKMEKCS | 3294 | | | | | | |
| IGLIMVLSF | 3191 | NSSIGLIMVLSFLFL | 3295 | 0.0340 | 0.0009 | 0.0690 | −0.0010 | 0.0042 | |
| ILSVSSFLF | 3192 | KLAILSVSSFLFVEA | 3296 | | | | | | |
| LAILSVSSF | 3193 | MRKLAILSVSSFLFV | 3297 | 0.1200 | 0.0930 | 0.0500 | 0.0013 | 0.1100 | |
| MEKCSSVFN | 3194 | ICKMEKCSSVFNVVN | 3298 | | | | | | |
| VVNSSIGLI | 3195 | VFNVVNSSIGLIMVL | 3299 | 0.0015 | 0.2600 | 0.1800 | 0.0012 | 0.5000 | |
| YQCYGSSSN | 3196 | FQEYQCYGSSSNTRV | 3300 | | | | | | |
| YNELEMNYY | 3197 | INLYNELEMNYYGKQ | 3301 | | | | | | |
| YDNAGINLY | 3198 | ELNYDNAGINLYNEL | 3302 | 0.0001 | | −0.0003 | −0.0003 | | |
| IQNSLSTEW | 3199 | LKKIQNSLSTEWSPC | 3303 | | | | | | |
| WSPCSVTCG | 3200 | STEWSPCSVTCGNGI | 3304 | | | | | | |
| FILVNLLIF | 3201 | SFYFILVNLLIFHIN | 3305 | 0.0009 | 0.0004 | 0.0084 | −0.0007 | −0.0018 | |
| FYFILVNLL | 3202 | YISFYFILVNLLIFH | 3306 | 0.0006 | 0.0003 | 0.0020 | 0.0010 | −0.0003 | |
| IHKGHLEEK | 3203 | RRDIHKGHLEEKKDG | 3307 | | | | | | |
| IIKSNLRSG | 3204 | KDEIIKSNLRSGSSN | 3308 | | | | | | |
| ILVNLLIFH | 3205 | FYFILVNLLIFHING | 3309 | | | | | | |
| INGKIIKNS | 3206 | IFHINGKIIKNSEKD | 3310 | 0.0055 | 0.0120 | 0.0160 | 0.0400 | 0.0093 | 0.0020 |
| IPAIELPSE | 3207 | RLEIPAIELPSENER | 3311 | | | | | | |
| IPHQSSLPQ | 3208 | GYYIPHQSSLPQDNR | 3312 | | | | | | |
| IQNHTLETV | 3209 | SADIQNHTLETVNIS | 3313 | 0.0001 | | −0.0003 | −0.0003 | | 0.0012 |
| ISFYFILVN | 3210 | ILYISFYFILVNLLI | 3314 | | | | | | |
| LDEFKPIVQ | 3211 | DEDLDEFKPIVQYDN | 3315 | | | | | | |
| LEEKAAKET | 3212 | QEDLEEKAAKETLQG | 3316 | 0.0001 | | −0.0003 | −0.0002 | | |
| LEIPAIELP | 3213 | YGRLEIPAIELPSEN | 3317 | | | | | | |
| LEQRKADTK | 3214 | QRDLEQRKADTKKNL | 3318 | | | | | | |
| LERTKASKE | 3215 | QSDLERTKASKETLQ | 3319 | | | | | | |
| LETVNISDV | 3216 | NHTLETVNISDVNDF | 3320 | 0.0015 | | 0.0010 | −0.0003 | | −0.0005 |
| LIEHIINDD | 3217 | EGKLIEHIINDDDDK | 3321 | | | | | | |
| LKENKLNKE | 3218 | NIFLKENKLNKEGKL | 3322 | | | | | | |
| LLIFHINGK | 3219 | LVNLLIFHINGKIIK | 3323 | 0.0410 | 0.0530 | 0.1200 | 0.0290 | 0.1800 | |
| LQEQQSDLE | 3220 | KETLQEQQSDLEQER | 3324 | | | | | | |
| LQEQQSDSE | 3221 | KEKLQEQQSDSEQER | 3325 | | | | | | |
| LQGQQSDLE | 3222 | KETLQEQQSDLEQER | 3326 | | | | | | |
| LRNLGVSEN | 3223 | KSLLRNLGVSENIFL | 3327 | | 0.5700 | 0.0770 | 0.0021 | 1.6000 | |
| LRSGSSNSR | 3224 | KSNLRSGSSNSRNRI | 3328 | | | | | | |
| LTMSNVKNV | 3225 | DKELTMSNVKNVSQT | 3329 | 0.0001 | 0.0430 | 0.0410 | 0.0110 | 0.0710 | 0.0024 |
| LVNLLIFHI | 3226 | YFILVNLLIFHINGK | 3330 | 0.0006 | 0.0013 | 0.0059 | 0.0005 | 0.0040 | 0.0290 |
| VLSHNSYEK | 3227 | KKHVLSHNSYEKTKN | 3331 | | | | | | |
| VNDFQISKY | 3228 | ISDVNDFQISKYEDE | 3332 | 0.0001 | | −0.0003 | −0.0003 | | −0.0005 |
| VNISDVNDF | 3229 | LETVNISDVNDFQIS | 3333 | | | | | | |
| YDDSLIDEE | 3230 | SAEYDDSLIDEEEDD | 3334 | | | | | | |
| YGRLEIPAI | 3231 | EDLYGRLEIPAIELP | 3335 | 0.0002 | | −0.0003 | 0.0021 | | −0.0005 |
| YIPHQSSLP | 3232 | RGYYIPHQSSLPQDN | 3336 | | 0.0004 | 0.1700 | 0.0150 | 0.1500 | |
| FKIGSSDPA | 3233 | RHPFKIGSSDPADNA | 3337 | 0.0001 | 0.0003 | −0.0003 | 0.0380 | 0.0950 | |
| IDVHDLISD | 3234 | EPLIDVHDLISDMIK | 3338 | | | | | | |
| IFNKESLAE | 3235 | FFIIFNKESLAEKTN | 3339 | | | | | | |
| IGSSDPADN | 3236 | PFKIGSSDPADNANP | 3340 | | | | | | |
| LALFFIIFN | 3237 | VFFLALFFIIFNKES | 3341 | 0.0002 | −0.0002 | 0.0056 | −0.0007 | −0.0018 | |
| LATSVLAGL | 3238 | KYKLATSVLAGLLGN | 3342 | 0.0073 | 0.0075 | 0.6500 | 0.1300 | 2.6000 | |
| LGGVGLVLY | 3239 | TVLLGGVGLVLYNTE | 3343 | 0.0004 | | 0.0007 | −0.0002 | | |
| LGNVSTVLL | 3240 | AGLLGNVSTVLLGGV | 3344 | 0.0001 | 4.6000 | 0.4300 | 0.0012 | 0.5300 | 0.0012 |
| LLGNVSTVL | 3241 | LAGLLGNVSTVLLGG | 3345 | 0.0003 | 0.6400 | 0.3800 | 0.0006 | 0.5500 | |
| LSVFFLALF | 3242 | MKILSVFFLALFFII | 3346 | 0.0023 | 0.0019 | 0.0360 | 0.0023 | 0.0060 | |
| LVLYNTEKG | 3243 | GVGLVLYNTEKGRHP | 3347 | | | | | | |
| VFFLALFFI | 3244 | ILSVFFLALFFIIFN | 3348 | 0.0008 | 0.0005 | 0.0110 | 0.0031 | −0.0003 | |
| VHDLISDMI | 3245 | LIDVHDLISDMIKKE | 3349 | 0.0001 | 0.0004 | 0.0100 | 0.0096 | 0.0430 | 0.0940 |
| VLAGLLGNV | 3246 | ATSVLAGLLGNVSTV | 3350 | 0.0043 | | −0.0003 | 0.0005 | | 0.0039 |
| VLLGGVGLV | 3247 | VSTVLLGGVGLVLYN | 3351 | 0.0011 | 0.0002 | 0.0020 | −0.0002 | 0.0120 | |
| VNKRKSKYK | 3248 | LVEVNKRKSKYKLAT | 3352 | | | | | | |
| VSTVLLGGV | 3249 | LGNVSTVLLGGVGLV | 3353 | 0.0005 | 0.0006 | −0.0003 | −0.0003 | −0.0005 | −0.0005 |
| VTAQDVTPE | 3250 | DPQVTAQDVTPEPQ | 3574 | | | | | | |
| YKLATSVLA | 3251 | KSKYKLATSVLAGLL | 3354 | 0.0009 | 0.0082 | 1.9000 | 1.1000 | 2.7000 | 0.0150 |
| FDLFLVNGR | 3252 | LIFFDLFLVNGRDVQ | 3355 | | | 0.0470 | | | |
| FFDLFLVNG | 3253 | FLIFFDLFLVNGRDV | 3356 | | | | | | |
| FMKAVCVEV | 3254 | IGPFMKAVCVEVEKT | 3357 | 0.0038 | 0.0003 | 0.0019 | −0.0003 | 0.0820 | 0.0700 |
| FNRFLVGCH | 3255 | NVAFNRFLVGCHPSD | 3358 | | | | | | |
| IAGGLALLA | 3256 | AGGIAGGLALLACAG | 3359 | 0.0007 | | −0.0003 | 0.0004 | | −0.0005 |
| IAVFGIGQG | 3257 | GVKIAVFGIGQGINV | 3360 | | | | | | |
| LACAGLAYK | 3258 | LALLACAGLAYKFVV | 3361 | | | | | | |
| LALLACAGL | 3259 | AGGLALLACAGLAYK | 3362 | 0.0051 | | 0.0009 | 0.0003 | | −0.0005 |
| LAMKLIQQL | 3260 | AVPLAMKLIQQLNLN | 3363 | 0.1300 | | 0.0770 | 0.0400 | | 0.0350 |

TABLE XIXb-continued

Malaria DR Super Motif Peptide With Binding Data

| | | | | | | | | | |
|---|---|---|---|---|---|---|---|---|---|
| LAYKFVVPG | 3261 | CAGLAYKFVVPGAAT | 3364 | 0.0016 | 0.0006 | 0.0028 | 0.0007 | −0.0003 | |
| LIFFDLFLV | 3262 | IVFLIFFDLFLVNGR | 3365 | | | | | | |
| LTDGIPDSI | 3263 | VVILTDGIPDSIQDS | 3366 | 0.0001 | | −0.0003 | −0.0003 | | 0.0114 |
| LVGCHPSDG | 3264 | NRFLVGCHPSDGKCN | 3367 | | | | | | |
| LVIVFLIFF | 3265 | VKYLVIVFLIFFDLF | 3368 | | | 0.0010 | | | |
| LVVILTDGI | 3266 | ANQLVVILTDGIPDS | 3369 | 0.0003 | 0.0070 | 0.0054 | −0.0002 | 0.0420 | |
| MDCSGSIRR | 3267 | YLLMDCSGSIRRHNW | 3370 | | | | | | |
| MKAVCVEVE | 3268 | GPFMKAVCVEVEKTA | 3371 | | | | | | |
| VEKTASCGV | 3269 | CVEVEKTASCGVWDE | 3372 | 0.0001 | | 0.0095 | 0.0005 | | |
| VGCHPSDGK | 3270 | RFLVGCHPSDGKCNL | 3373 | | | | | | |
| VIGPFMKAV | 3271 | VKNVIGPFMKAVCVE | 3374 | 0.0920 | 0.1100 | 0.0590 | 0.0230 | 0.0870 | |
| VIVFLIFFD | 3272 | KYLVIVFLIFFDLFL | 3375 | 0.0021 | 0.0034 | 0.0130 | 0.0065 | −0.0018 | |
| VKYLVTVFL | 3273 | LGNVKYLVTVFLIFF | 3376 | 0.0011 | 0.0016 | 0.0040 | 0.0050 | 0.0012 | |
| VNGRDVQNN | 3274 | LFLVNGRDVQNNIVD | 3377 | | | | | | |
| WDEWSPCSV | 3275 | CGVWDEWSPCSVTCG | 3378 | 0.0001 | | −0.0003 | −0.0003 | | −0.0006 |
| IAGGIAGGL | 3276 | KYKIAGGIAGGLALL | 3379 | 0.3600 | 0.2400 | 0.0063 | 1.6000 | 0.2600 | −0.0010 |
| VQNNIVDEI | 3277 | GRDVQNNIVDEIKYR | 3380 | 0.0001 | 0.0810 | −0.0003 | −0.0003 | −0.0005 | 0.0850 |
| YLLMDCSGS | 3278 | VDLYLLMDCSGSIRR | 3381 | 0.0001 | | 0.0046 | 0.0007 | | −0.0010 |
| FVVPGAATP | 3279 | AYKFVVPGAATPYAG | 3382 | 0.1200 | 0.1700 | 0.1800 | 0.9200 | 0.1300 | |
| YKFVVPGAA | 3280 | GLAYKFVVPGAATPY | 3383 | 0.3500 | 0.4900 | 0.1500 | 2.5000 | 0.6000 | 0.0190 |
| IIRLHSDAS | 3281 | AKEIIRLHSDASKNK | 3384 | | | | | | |
| IIDNNPQEP | 3282 | EENIIDNNPQEPSPN | 3385 | | | | | | |
| VDLYLLMDC | 3283 | NDEVDLYLLMDCSGS | 3386 | 0.0001 | | −0.0003 | −0.0003 | | |
| LLSTNLPYG | 3284 | IKSLLSTNLPYGRTN | 3387 | | | | | | |
| LHEGCTSEL | 3285 | REILHEGCTSELQEQ | 3388 | 0.0001 | | −0.0003 | −0.0003 | | |
| VNHAVPLAM | 3286 | HNWVNHAVPLAMKLI | 3389 | 0.6000 | 0.9400 | 0.3800 | 0.7200 | 4.0000 | 0.0250 |
| VPGAATPYA | 3287 | KFVVPGAATPYAGEP | 3390 | 0.0860 | 0.0460 | 0.0017 | 0.0064 | 0.2500 | |
| VVPGAATPY | 3288 | YKFVVPGAATPYAGE | 3391 | 0.0001 | 0.0017 | 0.0160 | 0.0026 | 0.0200 | |
| WVNHAVPLA | 3289 | RHNWVNHAVPLAMKL | 3392 | 0.0240 | 0.8900 | 0.4400 | 1.8000 | 4.6000 | 0.0430 |
| LSTNLPYGR | 3290 | KSLLSTNLPYGRTNL | 3393 | | | 0.0005 | | | |

TABLE XXa

Malaria DR3a Motif Peptides

| Protein | Core Sequence | Core SeqID Num | Core Sequence Frequency | Core Sequence Conservancy (%) | Exemplary Sequence | Exemplary SeqID Num | Position in Pf Poly-Protein | Exemplary Sequence Frequency | Exemplary Conservancy (%) |
|---|---|---|---|---|---|---|---|---|---|
| CSP | LFQEYQCYG | 3394 | 19 | 100 | VEALFQEYQCYGSSS | 3449 | 16 | 19 | 100 |
| CSP | LFVEALFQE | 3395 | 19 | 100 | SSFLFVEALFQEYQC | 3450 | 11 | 19 | 100 |
| CSP | MPNDPNRNV | 3396 | 19 | 100 | GHNMPNDPNRNVDEN | 3451 | 347 | 19 | 100 |
| CSP | LYNELEMNY | 3397 | 19 | 100 | GINLYNELEMNYYGK | 3452 | 44 | 18 | 95 |
| CSP | VLNELNYDN | 3398 | 19 | 100 | NTRVLNELNYDNAGI | 3453 | 31 | 18 | 95 |
| CSP | YENDIEKKI | 3399 | 19 | 100 | ELDYENDIEKKICKM | 3454 | 422 | 12 | 63 |
| CSP | LNYDNAGIN | 3400 | 18 | 95 | LNELNYDNAGINLYN | 3455 | 35 | 18 | 95 |
| CSP | LSTEWSPCS | 3401 | 18 | 95 | QNSLSTEWSPCSVTC | 3456 | 389 | 15 | 79 |
| CSP | LDYENDIEK | 3402 | 18 | 95 | KDELDYENDIEKKIC | 3457 | 420 | 12 | 63 |
| LSA | FDGDNEILQ | 3403 | 1 | 100 | FHIFDGDNEILQIVD | 3458 | 1882 | 1 | 100 |
| LSA | FDKDKELTM | 3404 | 1 | 100 | NKFFDKDKELTMSNV | 3459 | 75 | 1 | 100 |
| LSA | FQDEENIGI | 3405 | 1 | 100 | YDNFQDEENIGIYKE | 3460 | 1791 | 1 | 100 |
| LSA | IDEEEDDED | 3406 | 1 | 100 | DSLIDEEEDDEDLDE | 3461 | 1770 | 1 | 100 |
| LSA | IINDDDDKK | 3407 | 1 | 100 | IEHIINDDDDKKKYI | 3462 | 124 | 1 | 100 |
| LSA | INDDDDKKK | 3408 | 1 | 100 | EHIINDDDDKKKYIK | 3463 | 125 | 1 | 100 |
| LSA | ISAEYDDSL | 3409 | 1 | 100 | EDEISAEYDDSLIDE | 3464 | 1761 | 1 | 100 |
| LSA | IVDELSEDI | 3410 | 1 | 100 | ILQIVDELSEDITKY | 3465 | 1891 | 1 | 100 |
| LSA | IYKELEDLI | 3411 | 1 | 100 | NIGIYKELEDLIEKN | 3466 | 1799 | 1 | 100 |
| LSA | LAEDLYGRL | 3412 | 1 | 100 | GDVLAEDLYGRLEIP | 3467 | 1645 | 1 | 100 |
| LSA | LAKEKLQEQ | 3413 | 1 | 100 | QERLAKEKLQEQQSD | 3468 | 1357 | 1 | 100 |
| LSA | LAKEKLQGQ | 3414 | 1 | 100 | QERLAKEKLQGQQSD | 3469 | 1119 | 1 | 100 |
| LSA | LANEKLQEQ | 3415 | 1 | 100 | QERLANEKLQEQQRD | 3470 | 1527 | 1 | 100 |
| LSA | LEQDRLAKE | 3416 | 1 | 100 | QSDLEQDRLAKEKLQ | 3471 | 1386 | 1 | 100 |
| LSA | LEQERLAKE | 3417 | 1 | 100 | QSDLEQERLAKEKLQ | 3472 | 1590 | 1 | 100 |
| LSA | LEQERLANE | 3418 | 1 | 100 | QSDLEQERLANEKLQ | 3473 | 1522 | 1 | 100 |
| LSA | LIDEEEDDE | 3419 | 1 | 100 | DDSLIDEEEDDEDLD | 3474 | 1769 | 1 | 100 |
| LSA | LPSENERGY | 3420 | 1 | 100 | AIELPSENERGYYIP | 3475 | 1660 | 1 | 100 |
| LSA | LSEDITKYF | 3421 | 1 | 100 | VDELSEDITKYFMKL | 3476 | 1895 | 1 | 100 |
| LSA | LSEEKIKKG | 3422 | 1 | 100 | SEELSEEKIKKGKKY | 3477 | 1827 | 1 | 100 |
| LSA | LYDEHIKKY | 3423 | 1 | 100 | DKSLYDEHIKKYKND | 3478 | 1853 | 1 | 100 |
| LSA | VLAEDLYGR | 3424 | 1 | 100 | HGDVLAEDLYGRLEI | 3479 | 1644 | 1 | 100 |
| LSA | VNKEKEKFI | 3425 | 1 | 100 | DKQVNKEKEKFIKSL | 3480 | 1867 | 1 | 100 |
| LSA | VQYDNFQDE | 3426 | 1 | 100 | KPIVQYDNFQDEENI | 3481 | 1786 | 1 | 100 |
| LSA | YEDEISAEY | 3427 | 1 | 100 | ISKYEDEISAEYDDS | 3482 | 1757 | 1 | 100 |
| LSA | YKNDKQVNK | 3428 | 1 | 100 | IKKYKNDKQVNKEKE | 3483 | 1861 | 1 | 100 |
| PfEXP | FNKESLAEK | 3429 | 1 | 100 | FIIFNKESLAEKTNK | 3484 | 13 | 1 | 100 |

TABLE XXa-continued

Malaria DR3a Motif Peptides

| Protein | Core Sequence | Core SeqID Num | Core Sequence Frequency | Core Sequence Conservancy (%) | Exemplary Sequence | Exemplary SeqID Num | Position in Pf Poly-Protein | Exemplary Sequence Frequency | Exemplary Conservancy (%) |
|---|---|---|---|---|---|---|---|---|---|
| PfEXP | IKKEEELVE | 3430 | 1 | 100 | SDMIKKEEELVEVNK | 3485 | 55 | 1 | 100 |
| PfEXP | LISDMIKKE | 3431 | 1 | 100 | VHDLISDMIKKEEEL | 3486 | 50 | 1 | 100 |
| PfEXP | VTPEQPQGD | 3432 | 1 | 100 | AQDVTPEQPQGDDNN | 3487 | 141 | 1 | 100 |
| PfEXP | YNTEKGRHP | 3433 | 1 | 100 | LVLYNTEKGRHPFKI | 3488 | 98 | 1 | 100 |
| SSP2 | IFFDLFLVN | 3434 | 10 | 100 | VFLIFFDLFLVNGRD | 3489 | 13 | 10 | 100 |
| SSP2 | ILTDGIPDS | 3435 | 10 | 100 | LVVILTDGIPDSIQD | 3490 | 156 | 10 | 100 |
| SSP2 | INRENANQL | 3436 | 10 | 100 | NDRINRENANQLVVI | 3491 | 145 | 10 | 100 |
| SSP2 | LHSDASKNK | 3437 | 10 | 100 | IIRLHSDASKNKEKA | 3492 | 100 | 10 | 100 |
| SSP2 | LYADSAWEN | 3438 | 10 | 100 | KCNLYADSAWENVKN | 3493 | 211 | 10 | 100 |
| SSP2 | VCVEVEKTA | 3439 | 10 | 100 | MKAVCVEVEKTASCG | 3494 | 231 | 10 | 100 |
| SSP2 | VEVEKTASC | 3440 | 10 | 100 | AVCVEVEKTASCGVW | 3495 | 233 | 10 | 100 |
| SSP2 | VPSDVPKNP | 3441 | 10 | 100 | EKEVPSDVPKNPEDD | 3496 | 384 | 10 | 100 |
| SSP2 | VWDEWSPCS | 3442 | 10 | 100 | SCGVWDEWSPCSVTC | 3497 | 243 | 10 | 100 |
| SSP2 | LLMDCSGSI | 3443 | 10 | 90 | DLYLLMDCSGSIRRH | 3498 | 48 | 9 | 90 |
| SSP2 | ILHEGCTSE | 3444 | 10 | 80 | KREILHEGCTSELQE | 3499 | 265 | 8 | 80 |
| SSP2 | IPEDSEKEV | 3445 | 10 | 80 | EPNIPEDSEKEVPSD | 3500 | 376 | 8 | 80 |
| SSP2 | YREEVCNDE | 3446 | 9 | 80 | EIKYREEVCNDEVDL | 3501 | 35 | 8 | 80 |
| SSP2 | VCNDEVDLY | 3447 | 8 | 80 | REEVCNDEVDLYLLM | 3502 | 39 | 8 | 80 |
| SSP2 | YAGEPAPFD | 3448 | 8 | 80 | ATPYAGEPAPFDETL | 3503 | 538 | 8 | 80 |

TABLE XXb

DR3a Motif Peptides With Binding Information

| Core Sequence | Core SeqID Num | Exemplary Sequence | Exemplary SeqID Num | DR 1 | DR2w2β | DR2wβ2 | DR3 | DR4w4 | DR4w15 | DR5w11 |
|---|---|---|---|---|---|---|---|---|---|---|
| LFQEYQCYG | 3394 | VEALFQEYQCYGSSS | 3449 | | | | 0.0082 | | | |
| LFVEALFQE | 3395 | SSFLFVEALFQEYQC | 3450 | | | | 0.0051 | | | |
| MPNDPNRNV | 3396 | GHNMPNDPNRNVDEN | 3451 | | | | −0.0033 | | | |
| LYNELEMNY | 3397 | GINLYNELEMNYYGK | 3452 | | | | 0.0270 | | | |
| VLNELNYDN | 3398 | NTRVLNELNYDNAGI | 3453 | | | | −0.0033 | | | |
| YENDIEKKI | 3399 | ELDYENDIEKKICKM | 3454 | | | | | | | |
| LNYDNAGIN | 3400 | LNELNYDNAGINLYN | 3455 | | | | | | | |
| LSTEWSPCS | 3401 | QNSLSTEWSPCSVTC | 3456 | | | | −0.0033 | | | |
| LDYENDIEK | 3402 | KDELDYENDIEKKIC | 3457 | | | | | | | |
| FDGDNEILQ | 3403 | FHIFDGDNEILQIVD | 3458 | | | | 0.0640 | | | |
| FDKDKELTM | 3404 | NKFFDKDKELTMSNV | 3459 | | | | | | | |
| FQDEENIGI | 3405 | YDNFQDEENIGIYKE | 3460 | | | | −0.0033 | | | |
| IDEEEDDED | 3406 | DSLIDEEEDDEDLDE | 3461 | | | | | | | |
| IINDDDDKK | 3407 | IEHIINDDDDKKKYI | 3462 | | | | | | | |
| INDDDDKKK | 3408 | EHIINDDDDKKKYIK | 3463 | | | | −0.0033 | | | |
| ISAEYDDSL | 3409 | EDEISAEYDDSLIDE | 3464 | | | | −0.0033 | | | |
| IVDELSEDI | 3410 | ILQIVDELSEDITKY | 3465 | 0.0001 | | −0.0005 | −0.0041 | 0.0027 | 0.0017 | −0.0002 |
| IYKELEDLI | 3411 | NIGIYKELEDLIEKN | 3466 | | | | −0.0033 | | | |
| LAEDLYGRL | 3412 | GDVLAEDLYGRLEIP | 3467 | | | | | | | |
| LAKEKLQEQ | 3413 | QERLAKEKLQEQQSD | 3468 | | | | | | | |
| LAKEKLQGQ | 3414 | QERLAKEKLQGQQSD | 3469 | | | | | | | |
| LANEKLQEQ | 3415 | QERLANEKLQEQQRD | 3470 | | | | −0.0033 | | | |
| LEQDRLAKE | 3416 | QSDLEQDRLAKEKLQ | 3471 | | | | 0.0038 | | | |
| LEQERLAKE | 3417 | QSDLEQERLAKEKLQ | 3472 | | | | −0.0033 | | | |
| LEQERLANE | 3418 | QSDLEQERLANEKLQ | 3473 | | | | | | | |
| LIDEEEDDE | 3419 | DDSLIDEEEDDEDLD | 3474 | | | | | | | |
| LPSENERGY | 3420 | AIELPSENERGYYIP | 3475 | | | | −0.0033 | | | |
| LSEDITKYF | 3421 | VDELSEDITKYFMKL | 3476 | | | | | | | |
| LSEEKIKKG | 3422 | SEELSEEKIKKGKKY | 3477 | | | | −0.0033 | | | |
| LYDEHIKKY | 3423 | DKSLYDEHIKKYKND | 3478 | 0.0001 | | −0.0005 | −0.0041 | −0.0007 | −0.0014 | −0.0002 |
| VLAEDLYGR | 3424 | HGDVLAEDLYGRLEI | 3479 | | | | | | | |
| VNKEKEKFI | 3425 | DKQVNKEKEKFIKSL | 3480 | | | | −0.0033 | | | |
| VQYDNFQDE | 3426 | KPIVQYDNFQDEENI | 3481 | | | | −0.0033 | | | |
| YEDEISAEY | 3427 | ISKYEDEISAEYDDS | 3482 | 0.0001 | | −0.0005 | −0.0041 | 0.0008 | −0.0014 | −0.0002 |
| YKNDKQVNK | 3428 | IKKYKNDKQVNKEKE | 3483 | | | | −0.0033 | | | |
| FNKESLAEK | 3429 | FIIFNKESLAEKTNK | 3484 | | | | 0.0040 | | | |
| IKKEEELVE | 3430 | SDMIKKEEELVEVNK | 3485 | | | | −0.0033 | | | |
| LISDMIKKE | 3431 | VHDLISDMIKKEEEL | 3486 | | | | | | | |
| VTPEQPQGD | 3432 | AQDVTPEQPQGDDNN | 3487 | | | | −0.0033 | | | |
| YNTEKGRHP | 3433 | LVLYNTEKGRHPFKI | 3488 | | | | | | | |
| IFFDLFLVN | 3434 | VFLIFFDLFLVNGRD | 3489 | | | | | | | |
| ILTDGIPDS | 3435 | LVVILTDGIPDSIQD | 3490 | 0.0002 | 0.0001 | −0.0006 | 0.1400 | 0.3600 | −0.0014 | −0.0004 |

TABLE XXb-continued

DR3a Motif Peptides With Binding Information

| | | | | | | | | | | |
|---|---|---|---|---|---|---|---|---|---|---|
| INRENANQL | 3436 | NDRINRENANQLVVI | 3491 | 0.0770 | | 0.0015 | 0.0092 | 0.0011 | 0.0010 | −0.0004 |
| LHSDASKNK | 3437 | IIRLHSDASKNKEKA | 3492 | | | | −0.0033 | | | |
| LYADSAWEN | 3438 | KCNLYADSAWENVKN | 3493 | 0.0002 | 0.0005 | −0.0010 | 0.3500 | −0.0055 | | −0.0006 |
| VCVEVEKTA | 3439 | MKAVCVEVEKTASCG | 3494 | | | | | | | |
| VEVEKTASC | 3440 | AVCVEVEKTASCGVW | 3495 | 0.0001 | | −0.0006 | −0.0041 | 0.0030 | −0.0014 | 0.0003 |
| VPSDVPKNP | 3441 | EKEVPSDVPKNPEDD | 3496 | | | | −0.0130 | | | |
| VWDEWSPCS | 3442 | SCGVWDEWSPCSVTC | 3497 | 0.0001 | | −0.0005 | −0.0041 | −0.0009 | −0.0009 | −0.0002 |
| LLMDCSGSI | 3443 | DLYLLMDCSGSIRRH | 3498 | 0.0041 | | 0.0250 | 0.0300 | 0.0340 | 0.0028 | −0.0002 |
| ILHEGCTSE | 3444 | KREILHEGCTSELQE | 3499 | | | | | | | |
| IPEDSEKEV | 3445 | EPNIPEDSEKEVPSD | 3500 | | | | −0.0130 | | | |
| YREEVCNDE | 3446 | EIKYREEVCNDEVDL | 3501 | | | | −0.0033 | | | |
| VCNDEVDLY | 3447 | REEVCNDEVDLYLLM | 3502 | 0.0003 | | −0.0006 | 0.1300 | −0.0006 | −0.0014 | −0.0004 |
| YAGEPAPFD | 3448 | ATPYAGEPAPFDETL | 3503 | | | | −0.0130 | | | |

| Core Sequence | Core SeqID Num | Exemplary Sequence | Exemplary SeqID Num | DR5w12 | DR6w19 | DR7 | DR8w2 | DR9 | DRw53 |
|---|---|---|---|---|---|---|---|---|---|
| LFQEYQCYG | 3394 | VEALFQEYQCYGSSS | 3449 | | | | | | |
| LFVEALFQE | 3395 | SSFLFVEALFQEYQC | 3450 | | | | | | |
| MPNDPNRNV | 3396 | GHNMPNDPNRNVDEN | 3451 | | | | | | |
| LYNELEMNY | 3397 | GINLYNELEMNYYGK | 3452 | | | | | | |
| VLNELNYDN | 3398 | NTRVLNELNYDNAGI | 3453 | | | | | | |
| YENDIEKKI | 3399 | ELDYENDIEKKICKM | 3454 | | | | | | |
| LNYDNAGIN | 3400 | LNELNYDNAGINLYN | 3455 | | | | | | |
| LSTEWSPCS | 3401 | QNSLSTEWSPCSVTC | 3456 | | | | | | |
| LDYENDIEK | 3402 | KDELDYENDIEKKIC | 3457 | | | | | | |
| FDGDNEILQ | 3403 | FHIFDGDNEILQIVD | 3458 | | | | | | |
| FDKDKELTM | 3404 | NKFFDKDKELTMSNV | 3459 | | | | | | |
| FQDEENIGI | 3405 | YDNFQDEENIGIYKE | 3460 | | | | | | |
| IDEEEDDED | 3406 | DSLIDEEEDDEDLDE | 3461 | | | | | | |
| IINDDDDKK | 3407 | IEHIINDDDDKKKYI | 3462 | | | | | | |
| INDDDDKKK | 3408 | EHIINDDDDKKKYIK | 3463 | | | | | | |
| ISAEYDDSL | 3409 | EDEISAEYDDSLIDE | 3464 | | | | | | |
| IVDELSEDI | 3410 | ILQIVDELSEDITKY | 3465 | 0.0001 | | −0.0003 | −0.0003 | | 0.0290 |
| IYKELEDLI | 3411 | NIGIYKELEDLIEKN | 3466 | | | | | | |
| LAEDLYGRL | 3412 | GDVLAEDLYGRLEIP | 3467 | | | | | | |
| LAKEKLQEQ | 3413 | QERLAKEKLQEQQSD | 3468 | | | | | | |
| LAKEKLQGQ | 3414 | QERLAKEKLQGQQSD | 3469 | | | | | | |
| LANEKLQEQ | 3415 | QERLANEKLQEQQRD | 3470 | | | | | | |
| LEQDRLAKE | 3416 | QSDLEQDRLAKEKLQ | 3471 | | | | | | |
| LEQERLAKE | 3417 | QSDLEQERLAKEKLQ | 3472 | | | | | | |
| LEQERLANE | 3418 | QSDLEQERLANEKLQ | 3473 | | | | | | |
| LIDEEEDDE | 3419 | DDSLIDEEEDDEDLD | 3474 | | | | | | |
| LPSENERGY | 3420 | AIELPSENERGYYIP | 3475 | | | | | | |
| LSEDITKYF | 3421 | VDELSEDITKYFMKL | 3476 | | | | | | |
| LSEEKIKKG | 3422 | SEELSEEKIKKGKKY | 3477 | | | | | | |
| LYDEHIKKY | 3423 | DKSLYDEHIKKYKND | 3478 | 0.0001 | | −0.0003 | −0.0003 | | 0.0006 |
| VLAEDLYGR | 3424 | HGDVLAEDLYGRLEI | 3479 | | | | | | |
| VNKEKEKFI | 3425 | DKQVNKEKEKFIKSL | 3480 | | | | | | |
| VQYDNFQDE | 3426 | KPIVQYDNFQDEENI | 3481 | | | | | | |
| YEDEISAEY | 3427 | ISKYEDEISAEYDDS | 3482 | 0.0001 | | −0.0003 | −0.0003 | | −0.0005 |
| YKNDKQVNK | 3428 | IKKYKNDKQVNKEKE | 3483 | | | | | | |
| FNKESLAEK | 3429 | FIIFNKESLAEKTNK | 3484 | | | | | | |
| IKKEEELVE | 3430 | SDMIKKEEELVEVNK | 3485 | | | | | | |
| LISDMIKKE | 3431 | VHDLISDMIKKEEEL | 3486 | | | | | | |
| VTPEQPQGD | 3432 | AQDVTPEQPQGDDNN | 3487 | | | | | | |
| YNTEKGRHP | 3433 | LVLYNTEKGRHPFKI | 3488 | | | | | | |
| IFFDLFLVN | 3434 | VFLIFFDLFLVNGRD | 3489 | | | | | | |
| ILTDGIPDS | 3435 | LVVILTDGIPDSIQD | 3490 | 0.0002 | 0.0002 | 0.0046 | −0.0003 | 0.0014 | 0.0480 |
| INRENANQL | 3436 | NDRINRENANQLVVI | 3491 | 0.0001 | | −0.0003 | −0.0003 | | 0.0096 |
| LHSDASKNK | 3437 | IIRLHSDASKNKEKA | 3492 | | | | | | |
| LYADSAWEN | 3438 | KCNLYADSAWENVKN | 3493 | | 0.0003 | −0.0014 | −0.0009 | | |
| VCVEVEKTA | 3439 | MKAVCVEVEKTASCG | 3494 | | | | | | |
| VEVEKTASC | 3440 | AVCVEVEKTASCGVW | 3495 | 0.0001 | | 0.0073 | 0.0006 | | 0.0022 |
| VPSDVPKNP | 3441 | EKEVPSDVPKNPEDD | 3496 | | | | | | |
| VWDEWSPCS | 3442 | SCGVWDEWSPCSVTC | 3497 | 0.0001 | | −0.0003 | −0.0003 | | |
| LLMDCSGSI | 3443 | DLYLLMDCSGSIRRH | 3498 | 0.0001 | | 0.0072 | 0.0014 | | 0.0057 |
| ILHEGCTSE | 3444 | KREILHEGCTSELQE | 3499 | | | | | | |
| IPEDSEKEV | 3445 | EPNIPEDSEKEVPSD | 3500 | | | | | | |
| YREEVCNDE | 3446 | EIKYREEVCNDEVDL | 3501 | | | | | | |
| VCNDEVDLY | 3447 | REEVCNDEVDLYLLM | 3502 | 0.0001 | | −0.0003 | −0.0003 | | −0.0010 |
| YAGEPAPFD | 3448 | ATPYAGEPAPFDETL | 3503 | | | | | | |

TABLE XXc

Malaria DR3b Motif Peptides

| Protein | Core Sequence | Core SeqID Num | Core Sequence Frequency | Core Sequence Conservancy (%) | Exemplary Sequence | Exemplary SeqID Num | Position in Pf Poly-Protein | Exemplary Sequence Frequency | Exemplary Conservancy (%) |
|---|---|---|---|---|---|---|---|---|---|
| CSP | LKKNSRSLG | 3504 | 19 | 100 | WYSLKKNSRSLGEND | 3539 | 62 | 19 | 100 |
| CSP | ANNDVKNNN | 3505 | 3 | 16 | NANANNDVKNNNNEE | 3540 | 361 | 3 | 16 |
| LSA | ADIQNHTLE | 3506 | 1 | 100 | DKSADIQNHTLETVN | 3541 | 1734 | 1 | 100 |
| LSA | FHINGKIIK | 3507 | 1 | 100 | LLIFHINGKIIKNSE | 3542 | 16 | 1 | 100 |
| LSA | FKPNDKSLY | 3508 | 1 | 100 | DNNFKPNDKSLYDEH | 3543 | 1846 | 1 | 100 |
| LSA | FLKENKLNK | 3509 | 1 | 100 | ENIFLKENKLNKEGK | 3544 | 108 | 1 | 100 |
| LSA | IEKTNRESI | 3510 | 1 | 100 | ISIIEKTNRESITTN | 3545 | 1693 | 1 | 100 |
| LSA | IKNSEKDEI | 3511 | 1 | 100 | GKIIKNSEKDEIIKS | 3546 | 23 | 1 | 100 |
| LSA | IKPEQKEDK | 3512 | 1 | 100 | DGSIKPEQKEDKSAD | 3547 | 1724 | 1 | 100 |
| LSA | IKSNLRSGS | 3513 | 1 | 100 | DEIIKSNLRSGSSNS | 3548 | 32 | 1 | 100 |
| LSA | INEEKHEKK | 3514 | 1 | 100 | RNRINEEKHEKKHVL | 3549 | 47 | 1 | 100 |
| LSA | LEQERRAKE | 3515 | 1 | 100 | QSDLEQERRAKEKLQ | 3550 | 1573 | 1 | 100 |
| LSA | LNKEGKLIE | 3516 | 1 | 100 | ENKLNKEGKLIEHII | 3551 | 114 | 1 | 100 |
| LSA | LPQDNRGNS | 3517 | 1 | 100 | QSSLPQDNRGNSRDS | 3552 | 1676 | 1 | 100 |
| LSA | LQEQQRDLE | 3518 | 1 | 100 | NEKLQEQQRDLEQER | 3553 | 1532 | 1 | 100 |
| PfEXP | AEKTNKGTG | 3519 | 1 | 100 | ESLAEKTNKGTGSGV | 3554 | 19 | 1 | I00 |
| PfEXP | LYNTEKGRH | 3520 | 1 | 100 | GLVLYNTEKGRHPFK | 3555 | 97 | 1 | 100 |
| PfEXP | VEVNKRKSK | 3521 | 1 | 100 | EELVEVNKRKSKYKL | 3556 | 62 | 1 | 100 |
| SSP2 | AWENVKNVI | 3522 | 10 | 100 | ADSAWENVKNVIGPF | 3557 | 216 | 10 | 100 |
| SSP2 | FLVNGRDVQ | 3523 | 10 | 100 | FDLFLVNGRDVQNNI | 3558 | 18 | 10 | 100 |
| SSP2 | LGEEDKDLD | 3524 | 10 | 100 | DETLGEEDKDLDEPE | 3559 | 549 | 10 | 100 |
| SSP2 | LDNERKQSD | 3525 | 10 | 80 | PKVLDNERKQSDPQS | 3560 | 435 | 8 | 80 |
| SSP2 | VLDNERKQS | 3526 | 10 | 70 | PPKVLDNERKQSDPQ | 3561 | 434 | 7 | 70 |
| SSP2 | IQDSLKESR | 3527 | 10 | 60 | PDSIQDSLKESRKLN | 3562 | 165 | 6 | 60 |
| SSP2 | IVDEIKYRE | 3528 | 9 | 90 | QNNIVDEIKYREEVC | 3563 | 29 | 9 | 90 |
| SSP2 | ALLQVRKHL | 3529 | 9 | 60 | LTDALLQVRKHLNDR | 3564 | 133 | 6 | 60 |
| SSP2 | LKESRKLND | 3530 | 6 | 50 | QDSLKESRKLNDRGV | 3565 | 169 | 5 | 50 |
| SSP2 | FSNNAKEII | 3531 | 6 | 40 | VNVFSNNAKEIIRLH | 3566 | 90 | 4 | 40 |
| SSP2 | YNDTPKHPE | 3532 | 5 | 50 | NRKYNDTPKHPEREE | 3567 | 479 | 5 | 50 |
| SSP2 | FSNNAREII | 3533 | 4 | 20 | LNIFSNNAREIIRLH | 3568 | 90 | 2 | 20 |
| SSP2 | LKESRKLSD | 3534 | 3 | 30 | QDSLKESRKLSDRGV | 3569 | 169 | 3 | 30 |
| SSP2 | YNDTPKYPE | 3535 | 2 | 20 | NRKYNDTPKYPEREE | 3570 | 479 | 2 | 20 |
| SSP2 | AGSDNKYKI | 3536 | 1 | 10 | KKKAGSDNKYKIAGG | 3571 | 501 | 1 | 10 |
| SSP2 | ALLEVRKHL | 3537 | 1 | 10 | LTDALLEVRKHLNDR | 3572 | 133 | 1 | 10 |
| SSP2 | IVDEIKYSE | 3538 | 1 | 10 | QNNIVDEIKYSEEVC | 3573 | 29 | 1 | 10 |

TABLE XXd

Malaria DR3b Motif Peptides With Binding Information

| Core Sequence Num | Core SeqID Num | Exemplary Sequence | Exemplary SeqID Num | DR 1 | DR2w2β1 | DR2w2β2 | DR3 | DR4w4 | DR4w15 | DR5w11 |
|---|---|---|---|---|---|---|---|---|---|---|
| LKKNSRSLG | 3504 | WYSLKKNSRSLGEND | 3539 | | | | | | | |
| ANNDVKNNN | 3505 | NANANNDVKNNNNEE | 3540 | | | | | | | |
| ADIQNHTLE | 3506 | DKSADIQNHTLETVN | 3541 | | | | | | | |
| FHINGKIIK | 3507 | LLIFHINGKIIKNSE | 3542 | 0.5700 | 0.2900 | 0.2500 | 0.5300 | 0.0060 | −0.0030 | 0.3600 |
| FKPNDKSLY | 3508 | DNNFKPNDKSLYDEH | 3543 | | | | 0.1700 | | | |
| FLKENKLNK | 3509 | ENIFLKENKLNKEGK | 3544 | | | | 0.0950 | | | |
| IEKTNRESI | 3510 | ISIIEKTNRESITTN | 3545 | | | | 0.1300 | | | |
| IKNSEKDEI | 3511 | GKIIKNSEKDEIIKS | 3546 | 0.0002 | | −0.0021 | −0.0160 | −0.0017 | 0.0030 | −0.0010 |
| IKPEQKEDK | 3512 | DGSIKPEQKEDKSAD | 3547 | | | | −0.0033 | | | |
| IKSNLRSGS | 3513 | DEIIKSNLRSGSSNS | 3548 | | | | 0.0050 | | | |
| INEEKHEKK | 3514 | RNRINEEKHEKKHVL | 3549 | | | | 0.0420 | | | |
| LEQERRAKE | 3515 | QSDLEQERRAKEKLQ | 3550 | | | | | | | |
| LNKEGKLIE | 3516 | ENKLNKEGKLIEHII | 3551 | 0.0001 | | −0.0021 | −0.0140 | −0.0017 | −0.0047 | −0.0005 |
| LPQDNRGNS | 3517 | QSSLPQDNRGNSRDS | 3552 | | | | −0.0033 | | | |
| LQEQQRDLE | 3518 | NEKLQEQQRDLEQER | 3553 | | | | | | | |
| AEKTNKGTG | 3519 | ESLAEKTNKGTGSGV | 3554 | | | | −0.0033 | | | |
| LYNTEKGRH | 3520 | GLVLYNTEKGRHPFK | 3555 | | | | | | | |
| VEVNKRKSK | 3521 | EELVEVNKRKSKYKL | 3556 | | | | 0.0880 | | | |
| AWENVKNVI | 3522 | ADSAWENVKNVIGPF | 3557 | | | | −0.0130 | | | |
| FLVNGRDVQ | 3523 | FDLFLVNGRDVQNNI | 3558 | | | | −0.0033 | | | |
| LGEEDKDLD | 3524 | DETLGEEDKDLDEPE | 3559 | | | | −0.0130 | | | |
| LDNERKQSD | 3525 | PKVLDNERKQSDPQS | 3560 | | | | −0.0130 | | | |
| VLDNERKQS | 3526 | PPKVLDNERKQSDPQ | 3561 | | | | −0.0130 | | | |
| IQDSLKESR | 3527 | PDSIQDSLKESRKLN | 3562 | −0.0001 | 0.0040 | −0.0018 | 0.8400 | −0.0055 | | −0.0006 |

TABLE XXd-continued

Malaria DR3b Motif Peptides With Binding Information

| | Core SeqID Num | Exemplary Sequence | Exemplary SeqID Num | | | | | | |
|---|---|---|---|---|---|---|---|---|---|
| IVDEIKYRE | 3528 | QNNIVDEIKYREEVC | 3563 | | | | | | |
| ALLQVRKHL | 3529 | LTDALLQVRKHLNDR | 3564 | | −0.0033 | | | | |
| LKESRKLND | 3530 | QDSLKESRKLNDRGV | 3565 | | | | | | |
| FSNNAKEII | 3531 | VNVFSNNAKEIIRLH | 3566 | | | | | | |
| YNDTPKHPE | 3532 | NRKYNDTPKHPEREE | 3567 | | | | | | |
| FSNNAREII | 3533 | LNIFSNNAREIIRLH | 3568 | | | | | | |
| LKESRKLSD | 3534 | QDSLKESRKLNDRGV | 3569 | | | | | | |
| YNDTPKYPE | 3535 | NRKYNDTPKYPEREE | 3570 | | | | | | |
| AGSDNKYKI | 3536 | KKKAGSDNKYKIAGG | 3571 | | | | | | |
| ALLEVRKHL | 3537 | LTDALLEVRKHLNDR | 3572 | | | | | | |
| IVDEIKYSE | 3538 | QNNIVDEIKYSEEVC | 3573 | | | | | | |

| Core Sequence | Core SeqID Num | Exemplary Sequence | Exemplary SeqID Num | DR5w12 | DR6w19 | DR7 | DR8w2 | DR9 | DRw53 |
|---|---|---|---|---|---|---|---|---|---|
| LKKNSRSLG | 3504 | WYSLKKNSRSLGEND | 3539 | | | | | | |
| ANNDVKNNN | 3505 | NANANNDVKNNNNEE | 3540 | | | | | | |
| ADIQNHTLE | 3506 | DKSADIQNHTLETVN | 3541 | | | | | | |
| FHINGKIIK | 3507 | LLIFHINGKIIKNSE | 3542 | 0.0230 | 0.0330 | 0.1300 | 0.1400 | 0.1500 | |
| FKPNDKSLY | 3508 | DNNFKPNDKSLYDEH | 3543 | | | | | | |
| FLKENKLNK | 3509 | ENIFLKENKLNKEGK | 3544 | | | | | | |
| IEKTNRESI | 3510 | ISIIEKTNRESITTN | 3545 | | | | | | |
| IKNSEKDEI | 3511 | GKIIKNSEKDEIIKS | 3546 | −0.0003 | | −0.0011 | −0.0007 | | |
| IKPEQKEDK | 3512 | DGSIKPEQKEDKSAD | 3547 | | | | | | |
| IKSNLRSGS | 3513 | DEIIKSNLRSGSSNS | 3548 | | | | | | |
| INEEKHEKK | 3514 | RNRINEEKHEKKHVL | 3549 | | | | | | |
| LEQERRAKE | 3515 | QSDLEQERRAKEKLQ | 3550 | | | | | | |
| LNKEGKLIE | 3516 | ENKLNKEGKLIEHII | 3551 | −0.0003 | | −0.0009 | −0.0007 | | |
| LPQDNRGNS | 3517 | QSSLPQDNRQNSRDS | 3552 | | | | | | |
| LQEQQRDLE | 3518 | NEKLQEQQRDLEQER | 3553 | | | | | | |
| AEKTNKGTG | 3519 | ESLAEKTNKGTGSGV | 3554 | | | | | | |
| LYNTEKGRH | 3520 | GLVLYNTEKGRHPFK | 3555 | | | | | | |
| VEVNKRKSK | 3521 | EELVEVNKRKSKYKL | 3556 | | | | | | |
| AWENVKNVI | 3522 | ADSAWENVKNVIGPF | 3557 | | | | | | |
| FLVNGRDVQ | 3523 | FDLFLVNGRDVQNNI | 3558 | | | | | | |
| LGEEDKDLD | 3524 | DETLGEEDKDLDEPE | 3559 | | | | | | |
| LDNERKQSD | 3525 | PKVLDNERKQSDPQS | 3560 | | | | | | |
| VLDNERKQS | 3526 | PPKVLDNERKQSDPQ | 3561 | | | | | | |
| IQDSLKESR | 3527 | PDSIQDSLKESRKLN | 3562 | | −0.0002 | −0.0014 | 0.0012 | | |
| IVDEIKYRE | 3528 | QNNIVDEIKYREEVC | 3563 | | | | | | |
| ALLQVRKHL | 3529 | LTDALLQVRKHLNDR | 3564 | | | | | | |
| LKESRKLND | 3530 | QDSLKESRKLNDRGV | 3565 | | | | | | |
| FSNNAKEII | 3531 | VNVFSNNAKEIIRLH | 3566 | | | | | | |
| YNDTPKHPE | 3532 | NRKYNDTPKHPEREE | 3567 | | | | | | |
| FSNNAREII | 3533 | LNIFSNNAREIIRLH | 3568 | | | | | | |
| LKESRKLSD | 3534 | QDSLKESRKLSDRGV | 3569 | | | | | | |
| YNDTPKYPE | 3535 | NRKYNDTPKYPEREE | 3570 | | | | | | |
| AGSDNKYKI | 3536 | KKKAGSDNKYKIAGG | 3571 | | | | | | |
| ALLEVRKHL | 3537 | LTDALLEVRKHLNDR | 3572 | | | | | | |
| IVDEIKYSE | 3538 | QNNIVDEIKYREEVC | 3573 | | | | | | |

TABLE XXI

Population coverage with combined HLA Supertypes

| | PHENOTYPIC FREQUENCY | | | | | |
|---|---|---|---|---|---|---|
| HLA-SUPERTYPES | Caucasian | North American Black | Japanese | Chinese | Hispanic | Average |
| a. Individual Supertypes | | | | | | |
| A2 | 45.8 | 39.0 | 42.4 | 45.9 | 43.0 | 43.2 |
| A3 | 37.5 | 42.1 | 45.8 | 52.7 | 43.1 | 44.2 |
| B7 | 38.6 | 52.7 | 48.8 | 35.5 | 47.1 | 44.7 |
| A1 | 47.1 | 16.1 | 21.8 | 14.7 | 26.3 | 25.2 |
| A24 | 23.9 | 38.9 | 58.6 | 40.1 | 38.3 | 40.0 |
| B44 | 43.0 | 21.2 | 42.9 | 39.1 | 39.0 | 37.0 |
| B27 | 28.4 | 26.1 | 13.3 | 13.9 | 35.3 | 23.4 |
| B62 | 12.6 | 4.8 | 36.5 | 25.4 | 11.1 | 18.1 |
| B58 | 10.0 | 25.1 | 1.6 | 9.0 | 5.9 | 10.3 |
| b. Combined Supertypes | | | | | | |
| A2, A3, B7 | 83.0 | 86.1 | 87.5 | 88.4 | 86.3 | 86.2 |
| A2, A3, B7, A24, B44, A1 | 99.5 | 98.1 | 100.0 | 99.5 | 99.4 | 99.3 |
| A2, A3, B7, A24, B44, A1, B27, B62, B58 | 99.9 | 99.6 | 100.0 | 99.8 | 99.9 | 99.8 |

TABLE XXII

Fixed analogs of *P. falciparum* CTL epitopes

| Supertype (or allele) | Peptide | Sequence | SEQ ID NO: | Source | Alleles bounds | Fixing strategy | Fixed sequence | SEQ ID NO: |
|---|---|---|---|---|---|---|---|---|
| A2 supertype | 1167.21 | FLIFFDLFLV | 3610 | Pf SSP2 14 | 5 | V2 | FVIFFDLFLV | 3803 |
| | 1167.16 | FMKAVCVEV | 3611 | Pf SSP2 230 | 5 | V2 | FVKAVCVEV | 3804 |
| | 1167.08 | GLIMVLSFL | 3612 | Pf CSP 425 | 4 | Vc | GLIMVLSFV | 3805 |
| | | | | | | V2 | GVIMVLSFL | 3806 |
| | | | | | | V2/Vc | GVIMVLSFV | 3807 |
| | 1167.12 | VLAGLLGNV | 3613 | Pf EXP1 80 | 4 | V2 | VVAGLLGNV | 3808 |
| | 1167.13 | KILSVFFLA | 3614 | Pf EXP1 2 | 3 | L2 | KLLSVFFLA | 3809 |
| | | | | | | V2 | KVLSVFFLA | 3810 |
| | | | | | | Vc | KILSVFFLV | 3811 |
| | | | | | | L2/Vc | KLLSVFFLV | 3812 |
| | | | | | | V2/Vc | KVLSVFFLV | 3813 |
| | 1167.10 | GLLGNVSTV | 3615 | Pf EXP1 83 | 3 | V2 | GVLGNVSTV | 3814 |
| | 1167.18 | ILSVSSFLFV | 3616 | Pf CSP 7 | 2 | V2 | IVSVSSFLFV | 3815 |
| | 1167.19 | VLLGGVGLVL | 3617 | Pf EXP1 91 | 2 | Vc | VLLGGVGLVV | 3816 |
| | | | | | | V2 | VVLGGVGLVL | 3817 |
| | | | | | | V2/Vc | VVLGGVGLVV | 3818 |
| A3-supertype | 1167.36 | LACAGLAYK | 3718 | Pf SSP2 511 | 4 | V2 | LVCAGLAYK | 3819 |
| | 1167.32 | QTNFKSLLR | 3619 | Pf LSA1 94 | 4 | V2 | QVNFKSLLR | 3820 |
| | 1167.43 | VTCGNGIQVR | 3620 | Pf CSP 375 | 4 | V2 | VVCGNGIQVR | 3821 |
| | 1167.24 | ALFFIIFNK | 3621 | Pf EXP1 10 | 3 | V2 | AVFFIIFNK | 3822 |
| | 1167.28 | GVSENIFLK | 3622 | Pf LSA1 105 | 3 | — | | |
| | 1167.47 | HVLSHNSYEK | 3623 | Pf LSA1 59 | 3 | — | | |
| | 1167.51 | LLACAGLAYK | 3624 | Pf SSP2 510 | 3 | V2 | LVACAGLAYK | 3823 |
| | 1167.46 | FILVNLLIFH | 3625 | Pf LSA1 11 | 2 | V2 | FVLVNLLIFH | 3824 |
| | | | | | | Rc | FILVNLLIFR | 3825 |
| | | | | | | Kc | FILVNLLIFK | 3826 |
| | | | | | | V2/Rc | FVLVNLLIFR | 3827 |
| | | | | | | V2/Kc | FVLVNLLIFK | 3828 |
| B7-supertype | 1167.61 | TPYAGEPAPF | 3626 | Pf SSP2 539 | 4 | Ic | TPYAGEPAPI | 3829 |
| | 19.0051 | LPYGRTNL | 3627 | Pf SSP2 126 | 3 | Ic | LPYGRTNI | 3830 |
| A1 | 16.0245 | FQDEENIGIY | 3628 | Pf LSA1 1794 | 1 | T2 | FTDEENIGIY | 3831 |
| | 16.0040 | FVEALFQEY | 3629 | Pf CSP 15 | 1 | D3 | FVDALFQEY | 3832 |
| | | | | | | T2 | FTEALFQEY | 3833 |
| | 15.0184 | LPSENERGY | 3630 | Pf LSA1 1663 | 1 | D3 | LPDENERGY | 3834 |
| | | | | | | T2 | LTSENERGY | 3835 |
| | 16.0130 | PSDGKCNLY | 3631 | Pf SSP2 207 | 1 | T2 | PTDGKCNLY | 3836 |
| A24 | 1167.54 | FYFILVNLL | 3632 | Pf LSA1 9 | 1 | Fc | FYFILVNLF | 3837 |
| | 1167.53 | KYKLATSVL | 3633 | Pf EXP1 73 | 1 | Fc | KYKLATSVF | 3838 |
| | 1167.56 | KYLVIVFLI | 3634 | Pf SSP2 8 | 1 | Fc | KYLVIVFLF | 3839 |
| | 1167.55 | YYIPHQSSL | 3635 | Pf LSA1 1671 | 1 | Fc | YYIPHQSSF | 3840 |

[a]A2-supertype peptides are tested for binding to A*0201, A*0202, A*0203, A*0206, and A*6802. A3-supertype peptides are tested for binding to A*03, A*11, A*31011, A*3301, and A*6801. B7-supertype peptides are tested for binding to B*0702, B*3501, B*5101, B*5301, and B*5401. A1 and A24 peptides are tested for binding to A*0101 and A*2402, respectively.

TABLE XXIII

*Plasmodium falciparum* CTL-inducing epitopes

| Epitope | SEQ ID NO: | Antigen | Residues | HLA-restriction |
|---|---|---|---|---|
| GLIMVLSFL | 3636 | CSP | 386-394 | A2-supertype |
| ILSVSSFLFV | 3637 | CSP | 7-16 | A2-supertype |
| VLAGLLGNV | 3638 | Exp-1 | 80-88 | A2-supertype |
| KILSVFFLA | 3639 | Exp-1 | 2-10 | A2-supertype |
| GLLGNVSTV | 3640 | Exp-1 | 83-91 | A2-supertype |
| VLLGGVGLVL | 3641 | Exp-1 | 91-100 | A2-supertype |
| FLIFFDLFLV | 3642 | SSP2 | 14-23 | A2-supertype |
| VTCGNGIQVR | 3643 | CSP | 336-345 | A3-supertype |
| ALFFIIFNK | 3644 | Exp-1 | 10-18 | A3-supertype |
| QTNFKSLLR | 3645 | LSA-1 | 94-102 | A3-supertype |
| GVSENIFLK | 3646 | LSA-1 | 105-113 | A3-supertype |
| HVLSHNSYEK | 3647 | LSA-1 | 59-68 | A3-supertype |
| FILVNLLIFH | 3648 | LSA-1 | 11-20 | A3-supertype |
| TPYAGELPAPF | 3649 | SSP2 | 539-548 | B7-supertype |
| MPLETQLAI | 3650 | s16 | 77-85 | B7-supertype |
| MRKLAILSVSSFLVF | 3651 | CSP | 2-16 | DR-supermotif |
| MNYYGKQENWYSLKK | 3652 | CSP | 53-67 | DR-supermotif |
| RHNWVNHAVPLAMKLI | 3653 | SSP2 | 61-76 | DR-supermotif |
| VKNVIGPFMKAVCVE | 3654 | SSP2 | 223-237 | DR-supermotif |
| SSVFNVVNSSIGLIM | 3655 | CSP | 410-424 | DR-supermotif |
| AGLLGNVSTVSTVLLGGV | 3656 | EXP1 | 82-96 | DR-supermotif |
| KSKYKLATSVLAGLL | 3657 | EXP1 | 71-85 | DR-supermotif |
| GLAYKFVVPGAATPY | 3658 | SSP2 | 512-526 | DR-supermotif |
| KYKIAGGIAGGLALL | 3659 | SSP2 | 494-508 | DR-supermotif |

TABLE XXIV

MHC-peptide binding assays: cell lines and radiolabeled ligands.

| Species | Antigen | Allele | Cell line | Radiolabeled peptide Source | Radiolabeled peptide Sequence | SEQ ID NO: |
|---|---|---|---|---|---|---|
| A. Class I binding assays ||||||||
| Human | A1 | A*0101 | Steinlin | Hu. J chain 102-110 | YTAVVPLVY | 3660 |
| | A2 | A*0201 | PI | HBVc 18-27 F6->Y | FLPSDYFPSV | 3661 |
| | A2 | A*0202 | P815 (transfected) | HBVc 18-27 F6->Y | FLPSDYFPSV | 3662 |
| | A2 | A*0203 | FUN | HBVc 18-27 F6->Y | FLPSDYFPSV | 3663 |
| | A2 | A*0206 | CLA | HBVc 18-27 F6->Y | FLPSDYFPSV | 3664 |
| | A2 | A*0207 | 721.221 (transfected) | HBVc 18-27 F6->Y | FLPSDYFPSV | 3665 |
| | A3 | | GM3107 | non-natural (A3CON1) | KVFPYALINK | 3666 |
| | A11 | | BVR | non-natural (A3CON1) | KVFPYALINK | 3667 |
| | A24 | A*2402 | KAS116 | non-natural (A24CON1) | AYIDNYNKF | 3668 |
| | A31 | A*3101 | SPACH | non-natural (A3CON1) | KVFPYALINK | 3669 |
| | A33 | A*3301 | LWAGS | non-natural (A3CON1) | KVFPYALINK | 3670 |
| | A28/68 | A*6801 | C1R | HBVc 141-151 T7->Y | STLPETYVVRR | 3671 |
| | A28/68 | A*6802 | AMAI | HBV pol 646-654 C4->A | FTQAGYPAL | 3672 |
| | B7 | B*0702 | GM3107 | A2 sigal seq. 5-13 (L7->Y) | APRTLVYLL | 3673 |
| | B8 | B*0801 | Steinlin | HIVgp 586-593 Y1->F, Q5->Y | FLKDYQLL | 3674 |
| | B27 | B*2705 | LG2 | R 60s | FRYNGLIHR | 3675 |
| | B35 | B*3501 | C1R, BVR | non-natural (B35CON2) | FPFKYAAAF | 3676 |
| | B35 | B*3502 | TISI | non-natural (B35CON2) | FPFKYAAAF | 3677 |
| | B35 | B*3503 | EHM | non-natural (B35CON2) | FPFKYAAAF | 3678 |
| | B44 | B*4403 | PITQUT | EF-1 G6->Y | AEMGKYSFY | 3679 |
| | B51 | | KAS116 | non-natural (B35CON2) | FPFKYAAAF | 3680 |
| | B53 | B*5301 | AMAI | non-natural (B35CON2) | FPFKYAAAF | 3681 |
| | B54 | B*5401 | KT3 | non-natural (B35CON2) | FPFKYAAAF | 3682 |
| | Cw4 | Cw*0401 | C1R | non-natural (C4CON1) | QYDDAVYKL | 3683 |
| | Cw6 | Cw*0602 | 721.221 transfected | non-natural (C6CON1) | YRHDGGNVL | 3684 |
| | Cw7 | CW*0702 | 721.221 transfected | non-natural (C6CON1) | YRHDGGNVL | 3685 |
| Mouse | $D^b$ | | EL4 | Adenovirus E1A P7->Y | SGPSNTYPEI | 3686 |
| | $K^b$ | | EL4 | VSV NP 52-59 | RGYVFQGL | 3687 |
| | $D^d$ | | P815 | HIV-IIIB ENV G4->Y | RGPYRAFVTI | 3688 |
| | $K^d$ | | P815 | non-natural (KdCON1) | KFNPMKTYI | 3689 |
| | $L^d$ | | P815 | HBVs 28-39 | IPQSLDSYWTSL | 3690 |
| B. Class II binding assays ||||||||
| Human | DR1 | DRB1*0101 | LG2 | HA Y307-319 | YPKYVKQNTLKLAT | 3691 |
| | DR2 | DRB1*1501 | L466.1 | MBP 88-102Y | VVHFFKNIVTPRTPPY | 3692 |
| | DR2 | DRB1*1601 | L242.5 | non-natural (760.16) | YAAFAAAKTAAAFA | 3693 |
| | DR3 | DRB1*0301 | MAT | MT 65 kD Y3-13 | YKTIAFDEEARR | 3694 |
| | DR4w4 | DRB1*0401 | Preiss | non-natural (717.01) | YARFQSQTTLKQKT | 3695 |
| | DR4w10 | DRB1*0402 | YAR | non-natural (717.10) | YARFQRQTTLKAAA | 3696 |
| | DR4w14 | DRB1*0404 | BIN 40 | non-natural (717.01) | YARFQSQTTLKQKT | 3697 |
| | DR4w15 | DRB1*0405 | KT3 | non-natural (717.01) | YARFQSQTTLKQKT | 3698 |
| | DR7 | DRB1*0701 | Pitout | Tet. tox. 830-843 | QYIKANSKFIGITE | 3699 |
| | DR8 | DRB1*0802 | QLL | Tet. tox. 830-843 | QYIKANSKFIGITE | 3700 |
| | DR8 | DRB1*0803 | LUY | Tet. tox. 830-843 | QYIKANSKFIGITE | 3701 |
| | DR9 | DRB1*0901 | HID | Tet. tox. 830-843 | QYIKANSKFIGITE | 3702 |
| | DR11 | DRB1*1101 | Sweig | Tet. tox. 830-843 | QYIKANSKFIGITE | 3703 |
| | DR12 | DRB1*1201 | Herluf | unknown eluted peptide | EALIHQLKINPYVLS | 3704 |
| | DR13 | DRB1*1302 | H0301 | Tet. tox. 830-843 S->A | QYIKANAKFIGITE | 3705 |
| | DR51 | DRB5*0101 | GM3107 or L416.3 | Tet. tox. 830-843 | QYIKANAKFIGITE | 3706 |
| | DR51 | DRB5*0201 | L255.1 | HA 307-319 | PKYVKQNTLKLAT | 3707 |
| | DR52 | DRB3*0101 | MAT | Tet. tox. 830-843 | NGQIGNDPNRDIL | 3708 |
| | DR53 | DRB4*0101 | L257.6 | non-natural (717.01) | YARFQSQTTLKQKT | 3709 |
| | DQ3.1 | QA1*0301/DQB1.03( | PF | non-natural (ROIV) | YAHAAHAAHAAHAAHAA | 3710 |
| Mouse | $IA^b$ | | DB27.4 | non-natural (ROIV) | YAHAAHAAHAAHAAHAA | 3711 |
| | $IA^d$ | | A20 | non-natural (ROIV) | YAHAAHAAHAAHAAHAA | 3712 |
| | $IA^k$ | | CH-12 | HEL 46-61 | YNTDGSTDYGILQINSR | 3713 |
| | $IA^s$ | | LS102.9 | non-natural (ROIV) | YAHAAHAAHAAHAAHAA | 3714 |
| | $IA^u$ | | 91.7 | non-natural (ROIV) | YAHAAHAAHAAHAAHAA | 3715 |
| | $IE^d$ | | A20 | Lambda repressor 12-26 | YLEDARRKKAIYEKKK | 3716 |
| | $IE^k$ | | CH-12 | Lambda repressor 12-26 | YLEDARRKKAIYEKKK | 3717 |

TABLE XXV

Monoclonal antibodies used in MEC purification.

| Monoclonal antibody | Specificity |
|---|---|
| W6/32 | HLA-class I |
| B123.2 | HLA-B and C |
| IVD12 | HLA-DQ |
| LB3.1 | HLA-DR |
| M1/42 | H-2 class I |
| 28-14-8S | H-2 $D^b$ and $L^d$ |
| 34-5-8S | H-2 $D^d$ |
| B8-24-3 | H-2 $K^b$ |
| SF1-1.1.1 | H-2 $K^d$ |
| Y-3 | H-2 $K^b$ |
| 10.3.6 | H-2 $IA^k$ |
| 14.4.4 | H-2 $IE^d$, $IE^K$ |
| MKD6 | H-2 $IA^d$ |
| Y3JP | H-2 $IA^b$, $IA^S$, $IA^u$ |

TABLE XXVI

P. falciparum A2-supermotif CTL epitopes

| Peptide | AA | Sequence | SEQ ID NO: | Source | A*0201 | A*0202 | A*0203 | A*0206 | A*6802 | Alleles bound[a] |
|---|---|---|---|---|---|---|---|---|---|---|
| 1167.21 | 10 | FLIFFDLFLV | 3718 | Pf SSP2 14 | 12 | 10 | 5.9 | 11 | 333 | 5 |
| 1167.16 | 9 | FMKAVCVEV | 3719 | Pf SSP2 230 | 63 | 307 | 2.9 | 389 | 143 | 5 |
| 1167.12 | 9 | VLAGLLGNV | 3720 | Pf EXP1 80 | 19 | 24 | 0.67 | 31 | 606 | 4 |
| 1167.08 | 9 | GLIMVLSFL | 3721 | Pf CSP 425 | 22 | 20 | 3.6 | 74 | 4396 | 4 |
| 1167.13 | 9 | KILSVFFLA | 3722 | Pf EXP1 2 | 5.0 | 172 | 3448 | 8.0 | 9524 | 3 |
| 1167.10 | 9 | GLLGNVSTV | 3723 | Pf EXP1 83 | 24 | 1194 | 1.2 | 25 | 21053 | 3 |
| 1167.19 | 10 | VLLGGVGLVL | 3724 | Pf EXP1 91 | 94 | — | 2500 | 420 | 16000 | 2 |
| 1167.18 | 10 | ILSVSSFLFV | 3725 | Pf CSP 7 | 208 | 3583 | 19 | 587 | 2105 | 2 |

*A dash indicates IC50 nM > 30000.

TABLE XXVII

P. falciparum A3-supermotif CTL epitopes

| Peptide | AA | Sequence | SEQ ID NO: | Source | A*0301 | A*1101 | A*3101 | A*3301 | A*6801 | Alleles bound[a] |
|---|---|---|---|---|---|---|---|---|---|---|
| 1167.32 | 9 | QTNFKSLLR | 3726 | Pf LSA1 94 | 50 | 14 | 180 | 617 | 4 | 4 |
| 1167.36 | 9 | LACAGLAYK | 3727 | Pf SSP2 511 | 423 | 143 | 5294 | 64 | 32 | 4 |
| 1167.43 | 10 | VTCGNGIQVR | 3728 | Pf CSP 375 | 6875 | 11 | 15 | 64 | 444 | 4 |
| 1167.24 | 9 | ALFFIIFNK | 3729 | Pf EXP1 10 | 9.2 | 2.2 | 720 | 1261 | 73 | 3 |
| 1167.51 | 10 | LLACAGLAYK | 3730 | Pf SSP2 510 | 22 | 73 | 692 | 1526 | 24 | 3 |
| 1167.28 | 9 | GVSENIFLK | 3731 | Pf LSA1 105 | 151 | 5.0 | 2250 | 8286 | 10 | 3 |
| 1167.47 | 10 | HVLSHNSYEK | 3732 | Pf LSA1 59 | 407 | 200 | — | — | 114 | 3 |
| 1167.46 | 10 | FILVNLLIFH | 3733 | Pf LSA1 11 | 733 | 1333 | 1957 | 397 | 154 | 2 |

*A dash indicates IC50 nM > 30000.

TABLE XXVIII

P. falciparum B7-supermotif CTL epitopes

| Peptide | AA | Sequence | SEQ ID NO: | Source | B*0702 | B*3501 | B*5101 | B*5301 | B*5401 | Alleles bound[a] |
|---|---|---|---|---|---|---|---|---|---|---|
| 1167.61 | 10 | TPYAGEPAPF | 3734 | Pf SSP2 539 | 31 | 14 | 15 | 158 | 25000 | 4 |
| 19.0051 | 8 | LPYGRTNL | 3735 | Pf SSP2 126 | 50 | — | 32 | 15500 | 417 | 3 |

* A dash indicates 1050 nM > 30000.

TABLE XXIX

**P. falciparum HLA-A*0101 and A*2402 binding peptides**

| Motif | Peptide | AA | Sequence | SEQ ID NO: | Source | Binding capacity (IC50 nM) A*0101 | A*2401 |
|---|---|---|---|---|---|---|---|
| A1 | 16.0040 | 9 | FVEALFQEY | 3736 | Pf CSP 15 | 7.4 | |
| | 16.0245 | 10 | FQDEENIGIY | 3737 | Pf LSA1 1794 | 23 | |
| | 15.0184 | 9 | LPSENERGY | 3738 | | 37 | |
| | 16.0130 | 9 | PSDGKCNLY | 3739 | Pf SSP2 207 | 46 | |
| A24 | 1167.55 | 9 | YYIPHQSSL | 3740 | Pf LSA1 1671 | | 2.4 |
| | 1167.54 | 9 | FYFILVNLL | 3741 | Pf LSA1 9 | | 25 |
| | 1167.56 | 9 | KYLVIVFLI | 3742 | Pf SSP2 8 | | 34 |
| | 1167.53 | 9 | KYKLATSVL | 3743 | Pf EXP1 73 | | 75 |

15

TABLE XXX

HLA-DR screening panels

| Screening Panel | Antigen | Alleles | Representative Assay Allele | Alias | Phenotypic Frequencies Cauc. | Blk. | Jpn. | Chn. | Hisp. | Avg. |
|---|---|---|---|---|---|---|---|---|---|---|
| Primary | DR1 | DRB1*0101-03 | DRB1*0101 | (DR1) | 18.5 | 8.4 | 10.7 | 4.5 | 10.1 | 10.4 |
| | DR4 | DRB1*0401-12 | DRB1*0401 | (DR4w4) | 23.6 | 6.1 | 40.4 | 21.9 | 29.8 | 24.4 |
| | DR7 | DRB1*0701-02 | DRB1*0701 | (DR7) | 26.2 | 11.1 | 1.0 | 15.0 | 16.6 | 14.0 |
| | Panel total | | | | 59.6 | 24.5 | 49.3 | 38.7 | 51.1 | 44.6 |
| Secondary | DR2 | DRB1*1501-03 | DRB1*1501 | (DR2w2 β1) | 19.9 | 14.8 | 30.9 | 22.0 | 15.0 | 20.5 |
| | DR2 | DR135*0101 | DRB5*0101 | (DR2w2 β2) | — | — | — | — | — | — |
| | DR9 | DRB1*09011,09012 | DRB1*0901 | (DR9) | 3.6 | 4.7 | 24.5 | 19.9 | 6.7 | 11.9 |
| | DR13 | DRB1*1301-06 | DRB1*1302 | (DR6w19) | 21.7 | 16.5 | 14.6 | 12.2 | 10.5 | 15.1 |
| | Panel total | | | | 42.0 | 33.9 | 61.0 | 48.9 | 30.5 | 43.2 |
| Tertiary | DR4 | DRB1*0405 | DRB1*0405 | (DR4w15) | — | — | — | — | — | — |
| | DR8 | DRB1*0801-5 | DRB1*0802 | (DR8w2) | 5.5 | 10.9 | 25.0 | 10.7 | 23.3 | 15.1 |
| | DR11 | DRB1*1101-05 | DRB1*1101 | (DR5w11) | 17.0 | 18.0 | 4.9 | 19.4 | 18.1 | 15.5 |
| | Panel total | | | | 22.0 | 27.8 | 29.2 | 29.0 | 39.0 | 29.4 |
| Quarternary | DR3 | DRB1*0301-2 | DRB1*0301 | (DR3w17) | 17.7 | 19.5 | 0.4 | 7.3 | 14.4 | 11.9 |
| | DR12 | DRB1*1201-02 | DRB1*1201 | (DR5w12) | 2.8 | 5.5 | 13.1 | 17.6 | 5.7 | 8.9 |
| | Panel total | | | | 20.2 | 24.4 | 13.5 | 24.2 | 19.7 | 20.4 |

TABLE XXXI

P. falciparum derived HTL candidate epitopes

| Peptide | Sequence | SEQ ID NO: | Source | Binding capacity (IC50 nM) DR1 | DR2wβ1 | DR2w2β2 | DR4w4 | DR4w15 |
|---|---|---|---|---|---|---|---|---|
| F125.04 | RHNWVNHAVPLAMKLI | 3744 | Pf SSP2 61 | 26 | 260 | 83 | 14 | 317 |
| 1188.34 | HNWVNHAVPLAMKLI | 3745 | Pf SSP2 62 | 14 | 364 | 143 | 12 | 950 |
| 1188.16 | KSKYKLATSVLAGLL LVNLLIFHINGKIIKNSE | 3746 3747 | Pf EXP1 71 Pf LSA1 13 | 3.6 | 1247 | 24 | 7.1 | 47 |
| F125.02 | LVNLLIFHINGKIIKNS | 3748 | Pf LSA1 13 | 78 | 13 | 426 | — | 1810 |
| 27.0402 | LLIFHINGKIIKNSE | 3749 | Pf LSA1 16 | 8.8 | | 80 | 7500 | |
| 1188.32 | GLAYKFVVPGAATPY | 3750 | Pf SSP2 512 | 3.1 | — | 29 | 45 | 1407 |
| 27.0392 | SSVFNVVNSSIGLIM | 3751 | Pf CSP 410 | 42 | 314 | 2500 | 450 | 1652 |
| 27.0417 | VKNVIGPFMKAVCVE | 3752 | Pf SSP2 223 | 56 | 212 | 250 | — | — |
| 27.0388 | MRKLAILSVSSFLFV | 3753 | Pf CSP 2 | 50 | 18 | 1538 | 5769 | 1407 |
| 27.0387 | MNYYGKQENWYSLKK | 3754 | Pf CSP 53 | 6.4 | 9100 | 435 | 21 | 292 |
| 1188.38 | KYKIAGGIAGGLALL | 3755 | Pf SSP2 494 | 132 | — | 417 | 3750 | 22353 |
| 1188.13 | AGLLGNVSTVLLGGV | 3756 | Pf EXP1 82 | 116 | 379 | 15,385 | 6923 | 1056 |
| 27.0408 | QTNFKSLLRNLGVSE | 3757 | Pf LSA1 94 | 91 | 8273 | 5405 | 2500 | 1900 |
| 35.0171 | PDSIQDSLKESRKLN | 3758 | Pf SSP2 165 | — | 2285 | — | — | — |
| 35.0172 | KCNLYADSAWENVKN | 3759 | Pf SSP2 211 | 23425 | 18200 | — | — | — |

TABLE XXXI-continued

P. falciparum derived HTL candidate epitopes

| Peptide | Binding capacity (IC50 nM) | | | | | | | Alleles bound[2] |
| | DR5w11 | DR6w19 | DR7 | DR8w2 | DR9 | DR3 | DR5w12 | |
|---|---|---|---|---|---|---|---|---|
| F125.04 | 282 | 3.9 | 23 | 41 | 33 | 8751 | 441 | 11 |
| 1188.34 | 2703 | 3.7 | 66 | 68 | 19 | 1304 | 497 | 10 |
| 1188.16 | 30 | 427 | 13 | 45 | 28 | — | — | 9 |
| F125.02 | 408 | 66 | 260 | 766 | 625 | 19722 | 11610 | 8 |
| 27.0402 | 56 | 106 | 192 | 350 | 500 | 566 | 12957 | 8 |
| 1188.32 | 11 | 7.1 | 167 | 20 | 125 | — | 851 | 9 |
| 27.0392 | 1176 | 9.7 | 33 | 891 | 63 | — | — | 7 |
| 27.0417 | 476 | 32 | 424 | 2130 | 862 | — | 3239 | 7 |
| 27.0388 | 541 | 38 | 500 | — | 682 | | | 6 |
| 27.0387 | 351 | 3182 | 3788 | 538 | 22059 | | | 6 |
| 1188.38 | 87 | 15 | 3968 | 31 | 288 | | | 6 |
| 1188.13 | — | 0.76 | 58 | — | 142 | | | 5 |
| 27.0408 | 51 | 47 | 7813 | 69 | — | | | 4 |
| 35.0171 | — | — | — | — | — | 357 | | 1 |
| 35.0172 | — | 11061 | — | — | — | 857 | | 1 |

A dash (—) indicates IC50 > 20 μM.

TABLE XXXII

PBMC responses of individuals from the Irian Java endemic malaria region.

| | Percent individuals yielding positive responses (n) | | |
| Peptide | IFNγ | TNFa | Proliferation |
|---|---|---|---|
| CSP.2 | 11% (7) | 59% (39) | 9% (11) |
| LSA1.13 | 16% (9) | 30% (21) | 8% (10) |
| CSP.53 | 7% (4) | 53% (40) | 3% (4) |
| SSP2.61 | 7% (4) | 45% (36) | 7% (9) |
| SSP2.223 | 15% (9) | 42% (31) | 5% (6) |
| CSP.410 | 16% (9) | 47% (33) | 12% (14) |
| EXP1.82 | 29% (17) | 43% (32) | 6% (7) |
| EXP1.71 | 9% (5) | 49% (36) | 12% (14) |
| SSP2.512 | 14% (8) | 41% (30) | 3% (4) |
| SSP2.62 | 11% (6) | 42% (31) | 12% (14) |
| SSP2.494 | 7% (4) | 36% (26) | 2% (3) |

TABLE XXXIII

P. falciparum CTL epitopes

| Supertype (or allele) | Peptide | AA | Sequence | SEQ ID NO: | Source | Alleles bound[a] |
|---|---|---|---|---|---|---|
| A2-supertype | 1167.08 | 9 | GLIMVLSFL | 3760 | Pf CSP 425 | 4 |
| | 1167.10 | 9 | GLLGNVSTV | 3761 | Pf EXP1 83 | 3 |
| | 1167.12 | 9 | VLAGLLGNV | 3762 | Pf EXP1 80 | 4 |
| | 1167.13 | 9 | KILSVFFLA | 3763 | Pf EXP1 2 | 3 |
| | 1167.16 | 9 | FMKAVCVEV | 3764 | Pf SSP2 230 | 5 |
| | 1167.18 | 10 | ILSVSSFLFV | 3765 | Pf CSP 7 | 2 |
| | 1167.19 | 10 | VLLGGVGLVL | 3766 | Pf EXP1 91 | 2 |
| | 1167.21 | 10 | FLIFFDLFLV | 3767 | Pf SSP2 14 | 5 |
| A3-supertype | 1167.24 | 9 | ALFFIIFNK | 3768 | PF EXP1 10 | 3 |
| | 1167.28 | 9 | GVSENIFLK | 3769 | Pf LSA1 105 | 3 |
| | 1167.32 | 9 | QTNFKSLLR | 3770 | Pf LSA1 94 | 4 |
| | 1167.36 | 9 | LACAGLAYK | 3771 | Pf SSP2 511 | 4 |
| | 1167.43 | 10 | VTCGNGIQVR | 3772 | Pf CSP 375 | 4 |
| | 1167.46 | 10 | FILVNLLIFH | 3773 | Pf LSA1 11 | 2 |
| | 1167.47 | 10 | HVLSHNSYEK | 3774 | Pf LSA1 59 | 3 |
| | 1167.51 | 10 | LLACAGLAYK | 3775 | Pf SSP2 510 | 3 |
| B7-supertype | 19.0051 | 8 | LPYGRTNL | 3776 | Pf SSP2 126 | 3 |
| | 1167.61 | 10 | TPYAGEPAPF | 3777 | Pf SSP2 539 | 4 |
| A1 | 15.0184 | 9 | LPSENERGY | 3778 | Pf LSA1 1663 | 1 |
| | 16.0040 | 9 | FVEALFQEY | 3779 | Pf CSP 15 | 1 |
| | 16.0130 | 9 | PSDGKCNLY | 3780 | Pf SSP2 207 | 1 |
| | 16.0245 | 10 | FQDEENIGIY | 3781 | Pf LSA1 1794 | 1 |
| A24 | 1167.53 | 9 | KYKLATSVL | 3782 | Pf EXP1 73 | 1 |
| | 1167.54 | 9 | FYFILVNLL | 3783 | Pf LSA1 9 | 1 |
| | 1167.55 | 9 | YYIPHQSSL | 3784 | Pf LSA1 1671 | 1 |
| | 1167.56 | 9 | KYLVIVFLI | 3785 | Pf SSP2 8 | 1 |

[a]A2-supertype peptides are tested for binding to A*0201, A*0202, A*0203, A*0206, and A*6802. A3-supertype peptides are tested for binding to A*03, A*11, A*31011, A*3301, and A*6801. B7-supertype peptides are tested for binding to B*0702, B*3501, B*5101, B*5301, and B*5401. A1 and A24 peptides are tested for binding to A*0101 and A*2402, respectively.

TABLE XXXIV

*P. falciparum* HTL epitopes

| Motif | Peptide | Sequence | SEQ ID NO: | Source | Alleles bound[a] |
|---|---|---|---|---|---|
| DR-supermotif | F125.04 | RHNWVNHAVPLAMKLI | 3786 | Pf SSP2 61 | 11 |
| | 1188.16 | KSKYKLATSVLAGLL | 3787 | Pf EXP1 71 | 9 |
| | 27.0402 | LLIFHINGKIIKNSE | 3788 | Pf LSA1 16 | 9 (DR3) |
| | 1188.32 | GLAYKFVVPGAATPY | 3789 | Pf SSP2 512 | 9 |
| | 27.0392 | SSVFNVVNSSIGLIM | 3790 | Pf CSP 410 | 7 |
| | 27.0417 | VKNVIGPFMKAVCVE | 3791 | Pf SSP2 223 | 7 |
| | 27.0388 | MRKLAILSVSSFLFV | 3792 | Pf CSP 2 | 6 |
| | 27.0387 | MNYYGKQENWYSLKK | 3793 | Pf CSP53 | 6 |
| | 1188.38 | KYKIAGGIAGGLALL | 3794 | Pf SSP2 494 | 6 |
| | 1188.13 | AGLLGNVSTVLLGGV | 3795 | Pf EXP1 82 | 5 |
| | 27.0408 | QTNFKSLLRNLGVSE | 3796 | Pf LSA1 94 | 4 |
| DR3 | 35.0171 | PDSIQDSLKESRKLN | 3797 | Pf SSP2 165 | DR3 |
| | 35.0172 | KCNLYADSAWENVKN | 3798 | Pf SSP2 211 | DR3 |

[a] HLA-DR supermotif peptides are screened for binding to a panel alleles representing the 10 most common HLA antigens, including DR1, DR2w2 β1, DR2w2 β2, DR4w4, DR4w15, DR5w11, DR6w19, DR7, DR8w2, and DR9. Additional alleles that are tested include DR3, DR5w12, DR52a, and DR53. DR3-motif peptides are tested for binding to DR3.

TABLE XXXV

Estimated population coverage by a panel of *P. falciparum* derived HTL epitopes

| Antigen | Alleles | Representative assay | No. of epitopes[2] | Population coverage (phenotypic frequency) | | | | | |
|---|---|---|---|---|---|---|---|---|---|
| | | | | Cauc. | Blk. | Jpn. | Chn. | Hisp. | Avg. |
| DR1 | DRB1*0101-03 | DR1 | 11 | 18.5 | 8.4 | 10.7 | 4.5 | 10.1 | 10.4 |
| DR2 | DRB1*1501-03 | DR2w2 β1 | 6 | 19.9 | 14.8 | 30.9 | 22.0 | 15.0 | 20.5 |
| DR2 | DRB5*0101 | DR2w2 β2 | 7 | — | — | — | — | — | — |
| DR3 | DRB1*0301-2 | DR3 | 3 | 17.7 | 19.5 | 0.40 | 7.3 | 14.4 | 11.9 |
| DR4 | DRB1*0401-12 | DR4w4 | 5 | 23.6 | 6.1 | 40.4 | 21.9 | 29.8 | 24.4 |
| DR4 | DRB1*0401-12 | DR4w15 | 3 | — | — | — | — | — | — |
| DR7 | DRB1*0701-02 | DR7 | 8 | 26.2 | 11.1 | 1.0 | 15.0 | 16.6 | 14.0 |
| DR8 | DRB1*0801-5 | DR8w2 | 8 | 5.5 | 10.9 | 25.0 | 10.7 | 23.3 | 15.1 |
| DR9 | DRB1*09011,09012 | DR9 | 9 | 3.6 | 4.7 | 24.5 | 19.9 | 6.7 | 11.9 |
| DR11 | DRB1*1101-05 | DR5w11 | 9 | 17.0 | 18.0 | 4.9 | 19.4 | 18.1 | 15.5 |
| DR12 | DRB1*1201-2 | DR5w12 | 2 | 2.8 | 5.5 | 13.1 | 17.6 | 5.7 | 8.9 |
| DR13 | DRB1*1301-06 | DR6w19 | 10 | 21.7 | 16.5 | 14.6 | 12.2 | 10.5 | 15.1 |
| Total | | | | 97.0 | 83.9 | 98.8 | 95.5 | 95.6 | 94.7 |

SEQUENCE LISTING (3842 sequences)

SEQ ID NO: 1 - protein, 8 aa, Unknown
  Synthetic Peptide
AILSVSSF

SEQ ID NO: 2 - protein, 10 aa, Unknown
  Synthetic Peptide
AILSVSSFLF

SEQ ID NO: 3 - protein, 9 aa, Unknown
  Synthetic Peptide
ALFQEYQCY

SEQ ID NO: 4 - protein, 11 aa, Unknown
  Synthetic Peptide
EMNYYGKQENW

SEQ ID NO: 5 - protein, 8 aa, Unknown
  Synthetic Peptide
FLFVEALF

SEQ ID NO: 6 - protein, 11 aa, Unknown
  Synthetic Peptide
FLFVEALFQEY

SEQ ID NO: 7 - protein, 9 aa, Unknown
  Synthetic Peptide
FVEALFQEY

SEQ ID NO: 8 - protein, 8 aa, Unknown
  Synthetic Peptide
GLIMVLSF

SEQ ID NO: 9 - protein, 10 aa, Unknown
  Synthetic Peptide
GLIMVLSFLF

SEQ ID NO: 10 - protein, 9 aa, Unknown
  Synthetic Peptide
ILSVSSFLF

SEQ ID NO: 11 - protein, 8 aa, Unknown
  Synthetic Peptide
IMVLSFLF

SEQ ID NO: 12 - protein, 10 aa, Unknown
  Synthetic Peptide
KIQNSLSTEW

SEQ ID NO: 13 - protein, 10 aa, Unknown
  Synthetic Peptide
KLAILSVSSF

SEQ ID NO: 14 - protein, 9 aa, Unknown
  Synthetic Peptide
KMEKCSSVF

SEQ ID NO: 15 - protein, 9 aa, Unknown
  Synthetic Peptide
LIMVLSFLF

SEQ ID NO: 16 - protein, 8 aa, Unknown
  Synthetic Peptide
LSVSSFLF

SEQ ID NO: 17 - protein, 10 aa, Unknown
  Synthetic Peptide
NLYNELEMNY

SEQ ID NO: 18 - protein, 11 aa, Unknown
  Synthetic Peptide
NLYNELEMNYY

SEQ ID NO: 19 - protein, 10 aa, Unknown
  Synthetic Peptide
NTRVLNELNY

SEQ ID NO: 20 - protein, 9 aa, Unknown
  Synthetic Peptide
PSDKHIEQY

SEQ ID NO: 21 - protein, 8 aa, Unknown
  Synthetic Peptide
RVLNELNY

SEQ ID NO: 22 - protein, 10 aa, Unknown
  Synthetic Peptide
SIGLIMVLSF

SEQ ID NO: 23 - protein, 10 aa, Unknown
  Synthetic Peptide
SSFLFVEALF

SEQ ID NO: 24 - protein, 11 aa, Unknown
  Synthetic Peptide
SSIGLIMVLSF

SEQ ID NO: 25 - protein, 11 aa, Unknown
  Synthetic Peptide
VSSFLFVEALF

SEQ ID NO: 26 - protein, 9 aa, Unknown
  Synthetic Peptide
EVNKRKSKY

SEQ ID NO: 27 - protein, 9 aa, Unknown
  Synthetic Peptide
FLALFFIIF

SEQ ID NO: 28 - protein, 10 aa, Unknown
  Synthetic Peptide
ILSVFFLALF

SEQ ID NO: 29 - protein, 11 aa, Unknown
  Synthetic Peptide
ILSVFFLALFF

SEQ ID NO: 30 - protein, 11 aa, Unknown
  Synthetic Peptide
KILSVFFLALF

SEQ ID NO: 31 - protein, 10 aa, Unknown
  Synthetic Peptide
LLGGVGLVLY

SEQ ID NO: 32 - protein, 9 aa, Unknown
  Synthetic Peptide
LSVFFLALF

SEQ ID NO: 33 - protein, 10 aa, Unknown
  Synthetic Peptide
LSVFFLALFF

SEQ ID NO: 34 - protein, 11 aa, Unknown
  Synthetic Peptide
LVEVNKRKSKY

SEQ ID NO: 35 - protein, 9 aa, Unknown
  Synthetic Peptide
NTEKGRHPF

SEQ ID NO: 36 - protein, 8 aa, Unknown
  Synthetic Peptide
SVFFLALF

SEQ ID NO: 37 - protein, 9 aa, Unknown
  Synthetic Peptide
SVFFLALFF

SEQ ID NO: 38 - protein, 11 aa, Unknown
  Synthetic Peptide
VLLGGVGLVLY

SEQ ID NO: 39 - protein, 11 aa, Unknown
  Synthetic Peptide
DLDEFKPIVQY

SEQ ID NO: 40 - protein, 8 aa, Unknown
  Synthetic Peptide
DVLAEDLY

SEQ ID NO: 41 - protein, 10 aa, Unknown
  Synthetic Peptide
DVNDFQISKY

SEQ ID NO: 42 - protein, 10 aa, Unknown
  Synthetic Peptide
ELPSENERGY

SEQ ID NO: 43 - protein, 11 aa, Unknown
  Synthetic Peptide
ELPSENERGYY

SEQ ID NO: 44 - protein, 9 aa, Unknown
  Synthetic Peptide
ELSEDITKY

SEQ ID NO: 45 - protein, 10 aa, Unknown
  Synthetic Peptide
ELSEDITKYF

SEQ ID NO: 46 - protein, 11 aa, Unknown
  Synthetic Peptide
ETVNISDVNDF

SEQ ID NO: 47 - protein, 9 aa, Unknown
  Synthetic Peptide
FIKSLFHIF

SEQ ID NO: 48 - protein, 9 aa, Unknown
  Synthetic Peptide
FILVNLLIF

SEQ ID NO: 49 - protein, 8 aa, Unknown
  Synthetic Peptide
HILYISFY

SEQ ID NO: 50 - protein, 9 aa, Unknown
  Synthetic Peptide
HILYISFYF

SEQ ID NO: 51 - protein, 8 aa, Unknown
  Synthetic Peptide
HVLSHNSY

SEQ ID NO: 52 - protein, 11 aa, Unknown
  Synthetic Peptide
IINDDDDKKKY

SEQ ID NO: 53 - protein, 8 aa, Unknown
  Synthetic Peptide
ILVNLLIF

SEQ ID NO: 54 - protein, 8 aa, Unknown
  Synthetic Peptide
ILYISFYF

SEQ ID NO: 55 - protein, 8 aa, Unknown
  Synthetic Peptide
KIKKGKKY

SEQ ID NO: 56 - protein, 11 aa, Unknown
  Synthetic Peptide
KSLYDEHIKKY

SEQ ID NO: 57 - protein, 10 aa, Unknown
  Synthetic Peptide
KTKNNENNKF

SEQ ID NO: 58 - protein, 11 aa, Unknown
  Synthetic Peptide
KTKNNENNKFF

SEQ ID NO: 59 - protein, 8 aa, Unknown
  Synthetic Peptide
LSEDITKY

SEQ ID NO: 60 - protein, 9 aa, Unknown
  Synthetic Peptide
LSEDITKYF

SEQ ID NO: 61 - protein, 8 aa, Unknown
  Synthetic Peptide
NISDVNDF

SEQ ID NO: 62 - protein, 9 aa, Unknown
  Synthetic Peptide
NLGVSENIF

SEQ ID NO: 63 - protein, 10 aa, Unknown
  Synthetic Peptide
NVKNVSQTNF

SEQ ID NO: 64 - protein, 8 aa, Unknown
  Synthetic Peptide
PIVQYDNF

SEQ ID NO: 65 - protein, 8 aa, Unknown
  Synthetic Peptide
PSENERGY

SEQ ID NO: 66 - protein, 9 aa, Unknown
  Synthetic Peptide
PSENERGYY

SEQ ID NO: 67 - protein, 9 aa, Unknown
  Synthetic Peptide
QVNKEKEKF

SEQ ID NO: 68 - protein, 10 aa, Unknown
  Synthetic Peptide
SLYDEHIKKY

SEQ ID NO: 69 - protein, 10 aa, Unknown
  Synthetic Peptide
TVNISDVNDF

SEQ ID NO: 70 - protein, 10 aa, Unknown
  Synthetic Peptide
ALLACAGLAY

SEQ ID NO: 71 - protein, 9 aa, Unknown
  Synthetic Peptide
ASCGVWDEW

SEQ ID NO: 72 - protein, 11 aa, Unknown
  Synthetic Peptide
ATPYAGEPAPF

SEQ ID NO: 73 - protein, 10 aa, Unknown
  Synthetic Peptide
CSGSIRRHNW

SEQ ID NO: 74 - protein, 8 aa, Unknown
  Synthetic Peptide
DLDEPEQF

SEQ ID NO: 75 - protein, 10 aa, Unknown
  Synthetic Peptide
EVCNDEVDLY

SEQ ID NO: 76 - protein, 11 aa, Unknown
  Synthetic Peptide
EVEKTASCGVW

SEQ ID NO: 77 - protein, 8 aa, Unknown
  Synthetic Peptide
FLIFFDLF

SEQ ID NO: 78 - protein, 10 aa, Unknown
  Synthetic Peptide
FVVPGAATPY

SEQ ID NO: 79 - protein, 10 aa, Unknown
  Synthetic Peptide
GIGQGINVAF

SEQ ID NO: 80 - protein, 9 aa, Unknown
  Synthetic Peptide
GINVAFNRF

SEQ ID NO: 81 - protein, 8 aa, Unknown
  Synthetic Peptide
GSIRRHNW

SEQ ID NO: 82 - protein, 10 aa, Unknown
  Synthetic Peptide
IVFLIFFDLF

SEQ ID NO: 83 - protein, 8 aa, Unknown
  Synthetic Peptide
KTASCGVW

SEQ ID NO: 84 - protein, 11 aa, Unknown
  Synthetic Peptide
KTASCGVWDEW

SEQ ID NO: 85 - protein, 9 aa, Unknown
  Synthetic Peptide
LLACAGLAY

SEQ ID NO: 86 - protein, 11 aa, Unknown
  Synthetic Peptide
LLACAGLAYKF

SEQ ID NO: 87 - protein, 8 aa, Unknown
  Synthetic Peptide
LLSTNLPY

SEQ ID NO: 88 - protein, 8 aa, Unknown
  Synthetic Peptide
LVIVFLIF

SEQ ID NO: 89 - protein, 9 aa, Unknown
  Synthetic Peptide
LVIVFLIFF

SEQ ID NO: 90 - protein, 8 aa, Unknown
  Synthetic Peptide
NIVDEIKY

SEQ ID NO: 91 - protein, 8 aa, Unknown
  Synthetic Peptide
NLYADSAW

SEQ ID NO: 92 - protein, 9 aa, Unknown
  Synthetic Peptide
NVKNVIGPF

SEQ ID NO: 93 - protein, 9 aa, Unknown
  Synthetic Peptide
NVKYLVIVF

SEQ ID NO: 94 - protein, 9 aa, Unknown
  Synthetic Peptide
PSDGKCNLY

SEQ ID NO: 95 - protein, 8 aa, Unknown
  Synthetic Peptide
RLPEENEW

SEQ ID NO: 96 - protein, 9 aa, Unknown
  Synthetic Peptide
SLLSTNLPY

SEQ ID NO: 97 - protein, 8 aa, Unknown
  Synthetic Peptide
VIVFLIFF

SEQ ID NO: 98 - protein, 11 aa, Unknown
  Synthetic Peptide
VIVFLIFFDLF

SEQ ID NO: 99 - protein, 9 aa, Unknown
  Synthetic Peptide
VVPGAATPY

SEQ ID NO: 100 - protein, 9 aa, Unknown
  Synthetic Peptide
YLVIVFLIF

SEQ ID NO: 101 - protein, 10 aa, Unknown
  Synthetic Peptide
YLVIVFLIFF

SEQ ID NO: 102 - protein, 9 aa, Unknown
  Synthetic Peptide
HIEQYLKKI

SEQ ID NO: 103 - protein, 8 aa, Unknown
  Synthetic Peptide
KIQNSLST

SEQ ID NO: 104 - protein, 9 aa, Unknown
  Synthetic Peptide
YLKKIQNSL

SEQ ID NO: 105 - protein, 11 aa, Unknown
  Synthetic Peptide
YLKKIQNSLST

SEQ ID NO: 106 - protein, 8 aa, Unknown
  Synthetic Peptide
NANANNAV

SEQ ID NO: 107 - protein, 11 aa, Unknown
  Synthetic Peptide
NVDENANANNA

SEQ ID NO: 108 - protein, 9 aa, Unknown
  Synthetic Peptide
ELNYDNAGI

SEQ ID NO: 109 - protein, 11 aa, Unknown
  Synthetic Peptide
ELNYDNAGINL

SEQ ID NO: 110 - protein, 8 aa, Unknown
  Synthetic Peptide
GINLYNEL

SEQ ID NO: 111 - protein, 10 aa, Unknown
  Synthetic Peptide
GINLYNELEM

SEQ ID NO: 112 - protein, 10 aa, Unknown
  Synthetic Peptide
NAGINLYNEL

SEQ ID NO: 113 - protein, 11 aa, Unknown
  Synthetic Peptide
SLSTEWSPCSV

SEQ ID NO: 114 - protein, 9 aa, Unknown
  Synthetic Peptide
AILSVSSFL

SEQ ID NO: 115 - protein, 11 aa, Unknown
  Synthetic Peptide
AILSVSSFLFV

SEQ ID NO: 116 - protein, 9 aa, Unknown
  Synthetic Peptide
DIEKKICKM

SEQ ID NO: 117 - protein, 11 aa, Unknown
  Synthetic Peptide
GIQVRIKPGSA

SEQ ID NO: 118 - protein, 9 aa, Unknown
  Synthetic Peptide
GLIMVLSFL

SEQ ID NO: 119 - protein, 11 aa, Unknown
  Synthetic Peptide
GLIMVLSFLFL

SEQ ID NO: 120 - protein, 8 aa, Unknown
  Synthetic Peptide
ILSVSSFL

SEQ ID NO: 121 - protein, 10 aa, Unknown
  Synthetic Peptide
ILSVSSFLFV

SEQ ID NO: 122 - protein, 9 aa, Unknown
  Synthetic Peptide
IMVLSFLFL

SEQ ID NO: 123 - protein, 10 aa, Unknown
  Synthetic Peptide
IQVRIKPGSA

SEQ ID NO: 124 - protein, 11 aa, Unknown
  Synthetic Peptide
KICKMEKCSSV

SEQ ID NO: 125 - protein, 11 aa, Unknown
  Synthetic Peptide
KLAILSVSSFL

SEQ ID NO: 126 - protein, 10 aa, Unknown
  Synthetic Peptide
KLRKPKHKKL

SEQ ID NO: 127 - protein, 8 aa, Unknown
  Synthetic Peptide
KMEKCSSV

SEQ ID NO: 128 - protein, 11 aa, Unknown
  Synthetic Peptide
KMEKCSSVFNV

SEQ ID NO: 129 - protein, 8 aa, Unknown
  Synthetic Peptide
KQENWYSL

SEQ ID NO: 130 - protein, 10 aa, Unknown
  Synthetic Peptide
LAILSVSSFL

SEQ ID NO: 131 - protein, 8 aa, Unknown
  Synthetic Peptide
LIMVLSFL

SEQ ID NO: 132 - protein, 10 aa, Unknown
  Synthetic Peptide
LIMVLSFLFL

SEQ ID NO: 133 - protein, 8 aa, Unknown
  Synthetic Peptide
MMRKLAIL

SEQ ID NO: 134 - protein, 10 aa, Unknown
  Synthetic Peptide
MMRKLAILSV

SEQ ID NO: 135 - protein, 8 aa, Unknown
  Synthetic Peptide
MVLSFLFL

SEQ ID NO: 136 - protein, 10 aa, Unknown
  Synthetic Peptide
NANPNANPNA

SEQ ID NO: 137 - protein, 10 aa, Unknown
  Synthetic Peptide
NANPNVDPNA

SEQ ID NO: 138 - protein, 8 aa, Unknown
  Synthetic Peptide
NLYNELEM

SEQ ID NO: 139 - protein, 10 aa, Unknown
  Synthetic Peptide
NMPNDPNRNV

SEQ ID NO: 140 - protein, 10 aa, Unknown
  Synthetic Peptide
NQGNGQGHNM

SEQ ID NO: 141 - protein, 8 aa, Unknown
  Synthetic Peptide
NTRVLNEL

SEQ ID NO: 142 - protein, 8 aa, Unknown
  Synthetic Peptide
NVDENANA

SEQ ID NO: 143 - protein, 10 aa, Unknown
  Synthetic Peptide
NVDPNANPNA

SEQ ID NO: 144 - protein, 10 aa, Unknown
  Synthetic Peptide
NVDPNANPNV

SEQ ID NO: 145 - protein, 9 aa, Unknown
  Synthetic Peptide
NVVNSSIGL

SEQ ID NO: 146 - protein, 10 aa, Unknown
  Synthetic Peptide
NVVNSSIGLI

SEQ ID NO: 147 - protein, 11 aa, Unknown
  Synthetic Peptide
NVVNSSIGLIM

SEQ ID NO: 148 - protein, 9 aa, Unknown
  Synthetic Peptide
QVRIKPGSA

SEQ ID NO: 149 - protein, 11 aa, Unknown
  Synthetic Peptide
RVLNELNYDNA

SEQ ID NO: 150 - protein, 8 aa, Unknown
  Synthetic Peptide
SIGLIMVL

SEQ ID NO: 151 - protein, 11 aa, Unknown
  Synthetic Peptide
SIGLIMVLSFL

SEQ ID NO: 152 - protein, 9 aa, Unknown
  Synthetic Peptide
SLKKNSRSL

SEQ ID NO: 153 - protein, 9 aa, Unknown
  Synthetic Peptide
STEWSPCSV

SEQ ID NO: 154 - protein, 10 aa, Unknown
  Synthetic Peptide
STEWSPCSVT

SEQ ID NO: 155 - protein, 10 aa, Unknown
  Synthetic Peptide
SVFNVVNSSI

SEQ ID NO: 156 - protein, 8 aa, Unknown
  Synthetic Peptide
SVSSFLFV

SEQ ID NO: 157 - protein, 10 aa, Unknown
  Synthetic Peptide
SVSSFLFVEA

SEQ ID NO: 158 - protein, 11 aa, Unknown
  Synthetic Peptide
SVSSFLFVEAL

SEQ ID NO: 159 - protein, 8 aa, Unknown
  Synthetic Peptide
SVTCGNGI

SEQ ID NO: 160 - protein, 10 aa, Unknown
  Synthetic Peptide
SVTCGNGIQV

SEQ ID NO: 161 - protein, 10 aa, Unknown
  Synthetic Peptide
VLNELNYDNA

SEQ ID NO: 162 - protein, 9 aa, Unknown
  Synthetic Peptide
VTCGNGIQV

SEQ ID NO: 163 - protein, 11 aa, Unknown
  Synthetic Peptide
VTCGNGIQVRI

SEQ ID NO: 164 - protein, 8 aa, Unknown
  Synthetic Peptide
VVNSSIGL

SEQ ID NO: 165 - protein, 9 aa, Unknown
  Synthetic Peptide
VVNSSIGLI

SEQ ID NO: 166 - protein, 10 aa, Unknown
  Synthetic Peptide
VVNSSIGLIM

SEQ ID NO: 167 - protein, 11 aa, Unknown
  Synthetic Peptide
VVNSSIGLIMV

SEQ ID NO: 168 - protein, 10 aa, Unknown
  Synthetic Peptide
YQCYGSSSNT

SEQ ID NO: 169 - protein, 8 aa, Unknown
  Synthetic Peptide
ATSVLAGL

SEQ ID NO: 170 - protein, 9 aa, Unknown
  Synthetic Peptide
ATSVLAGLL

SEQ ID NO: 171 - protein, 9 aa, Unknown
  Synthetic Peptide
DMIKKEEEL

SEQ ID NO: 172 - protein, 10 aa, Unknown
  Synthetic Peptide
DMIKKEEELV

SEQ ID NO: 173 - protein, 9 aa, Unknown
  Synthetic Peptide
DVHDLISDM

SEQ ID NO: 174 - protein, 10 aa, Unknown
  Synthetic Peptide
DVHDLISDMI

SEQ ID NO: 175 - protein, 10 aa, Unknown
  Synthetic Peptide
EQPQGDDNNL

SEQ ID NO: 176 - protein, 11 aa, Unknown
  Synthetic Peptide
EQPQGDDNNLV

SEQ ID NO: 177 - protein, 11 aa, Unknown
  Synthetic Peptide
EVNKRKSKYKL

SEQ ID NO: 178 - protein, 9 aa, Unknown
  Synthetic Peptide
FIIFNKESL

SEQ ID NO: 179 - protein, 10 aa, Unknown
  Synthetic Peptide
FIIFNKESLA

SEQ ID NO: 180 - protein, 8 aa, Unknown
  Synthetic Peptide
FLALFFII

SEQ ID NO: 181 - protein, 8 aa, Unknown
  Synthetic Peptide
GLLGNVST

SEQ ID NO: 182 - protein, 9 aa, Unknown
  Synthetic Peptide
GLLGNVSTV

SEQ ID NO: 183 - protein, 10 aa, Unknown
  Synthetic Peptide
GLLGNVSTVL

SEQ ID NO: 184 - protein, 11 aa, Unknown
  Synthetic Peptide
GLLGNVSTVLL

SEQ ID NO: 185 - protein, 9 aa, Unknown
  Synthetic Peptide
GVGLVLYNT

SEQ ID NO: 186 - protein, 8 aa, Unknown
  Synthetic Peptide
IIFNKESL

SEQ ID NO: 187 - protein, 9 aa, Unknown
  Synthetic Peptide
IIFNKESLA

SEQ ID NO: 188 - protein, 8 aa, Unknown
  Synthetic Peptide
ILSVFFLA

SEQ ID NO: 189 - protein, 9 aa, Unknown
  Synthetic Peptide
ILSVFFLAL

SEQ ID NO: 190 - protein, 8 aa, Unknown
  Synthetic Peptide
KIGSSDPA

SEQ ID NO: 191 - protein, 11 aa, Unknown
  Synthetic Peptide
KIGSSDPADNA

SEQ ID NO: 192 - protein, 8 aa, Unknown
  Synthetic Peptide
KILSVFFL

SEQ ID NO: 193 - protein, 9 aa, Unknown
  Synthetic Peptide
KILSVFFLA

SEQ ID NO: 194 - protein, 10 aa, Unknown
  Synthetic Peptide
KILSVFFLAL

SEQ ID NO: 195 - protein, 8 aa, Unknown
  Synthetic Peptide
KLATSVLA

SEQ ID NO: 196 - protein, 10 aa, Unknown
  Synthetic Peptide
KLATSVLAGL

SEQ ID NO: 197 - protein, 11 aa, Unknown
  Synthetic Peptide
KLATSVLAGLL

SEQ ID NO: 198 - protein, 10 aa, Unknown
  Synthetic Peptide
KTNKGTGSGV

SEQ ID NO: 199 - protein, 9 aa, Unknown
  Synthetic Peptide
LAEKTNKGT

SEQ ID NO: 200 - protein, 8 aa, Unknown
  Synthetic Peptide
LAGLLGNV

SEQ ID NO: 201 - protein, 10 aa, Unknown
  Synthetic Peptide
LAGLLGNVST

SEQ ID NO: 202 - protein, 11 aa, Unknown
  Synthetic Peptide
LAGLLGNVSTV

SEQ ID NO: 203 - protein, 9 aa, Unknown
  Synthetic Peptide
LATSVLAGL

SEQ ID NO: 204 - protein, 10 aa, Unknown
  Synthetic Peptide
LATSVLAGLL

SEQ ID NO: 205 - protein, 8 aa, Unknown
  Synthetic Peptide
LIDVHDLI

SEQ ID NO: 206 - protein, 11 aa, Unknown
  Synthetic Peptide
LIDVHDLISDM

SEQ ID NO: 207 - protein, 8 aa, Unknown
  Synthetic Peptide
LLGGVGLV

SEQ ID NO: 208 - protein, 9 aa, Unknown
  Synthetic Peptide
LLGGVGLVL

SEQ ID NO: 209 - protein, 8 aa, Unknown
  Synthetic Peptide
LLGNVSTV

SEQ ID NO: 210 - protein, 9 aa, Unknown
  Synthetic Peptide
LLGNVSTVL

SEQ ID NO: 211 - protein, 10 aa, Unknown
  Synthetic Peptide
LLGNVSTVLL

SEQ ID NO: 212 - protein, 8 aa, Unknown
  Synthetic Peptide
MIKKEEEL

SEQ ID NO: 213 - protein, 9 aa, Unknown
  Synthetic Peptide
MIKKEEELV

SEQ ID NO: 214 - protein, 11 aa, Unknown
  Synthetic Peptide
MIKKEEELVEV

SEQ ID NO: 215 - protein, 8 aa, Unknown
  Synthetic Peptide
NADPQVTA

SEQ ID NO: 216 - protein, 11 aa, Unknown
  Synthetic Peptide
NADPQVTAQDV

SEQ ID NO: 217 - protein, 11 aa, Unknown
  Synthetic Peptide
NTEKGRHPFKI

SEQ ID NO: 218 - protein, 10 aa, Unknown
  Synthetic Peptide
NVSTVLLGGV

SEQ ID NO: 219 - protein, 9 aa, Unknown
  Synthetic Peptide
PADNANPDA

SEQ ID NO: 220 - protein, 8 aa, Unknown
  Synthetic Peptide
PLIDVHDL

SEQ ID NO: 221 - protein, 9 aa, Unknown
  Synthetic Peptide
PLIDVHDLI

SEQ ID NO: 222 - protein, 8 aa, Unknown
  Synthetic Peptide
PQGDDNNL

SEQ ID NO: 223 - protein, 9 aa, Unknown
  Synthetic Peptide
PQGDDNNLV

SEQ ID NO: 224 - protein, 8 aa, Unknown
  Synthetic Peptide
PQVTAQDV

SEQ ID NO: 225 - protein, 9 aa, Unknown
  Synthetic Peptide
PQVTAQDVT

SEQ ID NO: 226 - protein, 8 aa, Unknown
  Synthetic Peptide
QVTAQDVT

SEQ ID NO: 227 - protein, 10 aa, Unknown
  Synthetic Peptide
SLAEKTNKGT

SEQ ID NO: 228 - protein, 8 aa, Unknown
  Synthetic Peptide
STVLLGGV

SEQ ID NO: 229 - protein, 10 aa, Unknown
  Synthetic Peptide
STVLLGGVGL

SEQ ID NO: 230 - protein, 11 aa, Unknown
  Synthetic Peptide
STVLLGGVGLV

SEQ ID NO: 231 - protein, 10 aa, Unknown
  Synthetic Peptide
SVFFLALFFI

SEQ ID NO: 232 - protein, 11 aa, Unknown
  Synthetic Peptide
SVFFLALFFII

SEQ ID NO: 233 - protein, 10 aa, Unknown
  Synthetic Peptide
SVLAGLLGNV

SEQ ID NO: 234 - protein, 9 aa, Unknown
  Synthetic Peptide
TVLLGGVGL

SEQ ID NO: 235 - protein, 10 aa, Unknown
  Synthetic Peptide
TVLLGGVGLV

SEQ ID NO: 236 - protein, 11 aa, Unknown
  Synthetic Peptide
TVLLGGVGLVL

SEQ ID NO: 237 - protein, 9 aa, Unknown
  Synthetic Peptide
VLAGLLGNV

SEQ ID NO: 238 - protein, 11 aa, Unknown
  Synthetic Peptide
VLAGLLGNVST

SEQ ID NO: 239 - protein, 8 aa, Unknown
  Synthetic Peptide
VLLGGVGL

SEQ ID NO: 240 - protein, 9 aa, Unknown
  Synthetic Peptide
VLLGGVGLV

SEQ ID NO: 241 - protein, 10 aa, Unknown
  Synthetic Peptide
VLLGGVGLVL

SEQ ID NO: 242 - protein, 9 aa, Unknown
  Synthetic Peptide
DIQNHTLET

SEQ ID NO: 243 - protein, 10 aa, Unknown
  Synthetic Peptide
DIQNHTLETV

SEQ ID NO: 244 - protein, 9 aa, Unknown
  Synthetic Peptide
DITKYFMKL

SEQ ID NO: 245 - protein, 8 aa, Unknown
  Synthetic Peptide
DLDEFKPI

SEQ ID NO: 246 - protein, 9 aa, Unknown
  Synthetic Peptide
DLDEFKPIV

SEQ ID NO: 247 - protein, 10 aa, Unknown
  Synthetic Peptide
DLEEKAAKET

SEQ ID NO: 248 - protein, 11 aa, Unknown
  Synthetic Peptide
DLEEKAAKETL

SEQ ID NO: 249 - protein, 8 aa, Unknown
  Synthetic Peptide
DLEQDRLA

SEQ ID NO: 250 - protein, 8 aa, Unknown
  Synthetic Peptide
DLEQERLA

SEQ ID NO: 251 - protein, 8 aa, Unknown
  Synthetic Peptide
DLEQERRA

SEQ ID NO: 252 - protein, 9 aa, Unknown
  Synthetic Peptide
DLEQRKADT

SEQ ID NO: 253 - protein, 11 aa, Unknown
  Synthetic Peptide
DLERTKASKET

SEQ ID NO: 254 - protein, 9 aa, Unknown
  Synthetic Peptide
DLIEKNENL

SEQ ID NO: 255 - protein, 8 aa, Unknown
  Synthetic Peptide
DLYGRLEI

SEQ ID NO: 256 - protein, 10 aa, Unknown
  Synthetic Peptide
DLYGRLEIPA

SEQ ID NO: 257 - protein, 11 aa, Unknown
  Synthetic Peptide
DLYGRLEIPAI

SEQ ID NO: 258 - protein, 11 aa, Unknown
  Synthetic Peptide
DVLAEDLYGRL

SEQ ID NO: 259 - protein, 9 aa, Unknown
  Synthetic Peptide
EILQIVDEL

SEQ ID NO: 260 - protein, 10 aa, Unknown
  Synthetic Peptide
EISAEYDDSL

SEQ ID NO: 261 - protein, 11 aa, Unknown
  Synthetic Peptide
EISAEYDDSLI

SEQ ID NO: 262 - protein, 8 aa, Unknown
  Synthetic Peptide
EISIIEKT

SEQ ID NO: 263 - protein, 11 aa, Unknown
  Synthetic Peptide
ELSEDITKYFM

SEQ ID NO: 264 - protein, 10 aa, Unknown
  Synthetic Peptide
ELTMSNVKNV

SEQ ID NO: 265 - protein, 10 aa, Unknown
  Synthetic Peptide
EQDRLAKEKL

SEQ ID NO: 266 - protein, 10 aa, Unknown
  Synthetic Peptide
EQERLAKEKL

SEQ ID NO: 267 - protein, 10 aa, Unknown
  Synthetic Peptide
EQERLANEKL

SEQ ID NO: 268 - protein, 10 aa, Unknown
  Synthetic Peptide
EQERRAKEKL

SEQ ID NO: 269 - protein, 8 aa, Unknown
  Synthetic Peptide
EQKEDKSA

SEQ ID NO: 270 - protein, 10 aa, Unknown
  Synthetic Peptide
EQKEDKSADI

SEQ ID NO: 271 - protein, 11 aa, Unknown
  Synthetic Peptide
EQQRDLEQERL

SEQ ID NO: 272 - protein, 11 aa, Unknown
  Synthetic Peptide
EQQRDLEQRKA

SEQ ID NO: 273 - protein, 11 aa, Unknown
  Synthetic Peptide
EQQSDLEQDRL

SEQ ID NO: 274 - protein, 11 aa, Unknown
  Synthetic Peptide
EQQSDLEQERL

SEQ ID NO: 275 - protein, 9 aa, Unknown
  Synthetic Peptide
EQQSDLERT

SEQ ID NO: 276 - protein, 11 aa, Unknown
  Synthetic Peptide
EQQSDLERTKA

SEQ ID NO: 277 - protein, 11 aa, Unknown
  Synthetic Peptide
EQQSDSEQERL

SEQ ID NO: 278 - protein, 11 aa, Unknown
  Synthetic Peptide
EQRKADTKKNL

SEQ ID NO: 279 - protein, 10 aa, Unknown
  Synthetic Peptide
ETLQEQQSDL

SEQ ID NO: 280 - protein, 10 aa, Unknown
  Synthetic Peptide
ETLQGQQSDL

SEQ ID NO: 281 - protein, 8 aa, Unknown
  Synthetic Peptide
ETVNISDV

SEQ ID NO: 282 - protein, 8 aa, Unknown
  Synthetic Peptide
FIKSLFHI

SEQ ID NO: 283 - protein, 8 aa, Unknown
  Synthetic Peptide
FILVNLLI

SEQ ID NO: 284 - protein, 11 aa, Unknown
  Synthetic Peptide
FILVNLLIFHI

SEQ ID NO: 285 - protein, 9 aa, Unknown
  Synthetic Peptide
FQDEENIGI

SEQ ID NO: 286 - protein, 10 aa, Unknown
  Synthetic Peptide
FQISKYEDEI

SEQ ID NO: 287 - protein, 9 aa, Unknown
  Synthetic Peptide
GIEKSSEEL

SEQ ID NO: 288 - protein, 9 aa, Unknown
  Synthetic Peptide
GIYKELEDL

SEQ ID NO: 289 - protein, 10 aa, Unknown
  Synthetic Peptide
GIYKELEDLI

SEQ ID NO: 290 - protein, 10 aa, Unknown
  Synthetic Peptide
GQDENRQEDL

SEQ ID NO: 291 - protein, 11 aa, Unknown
  Synthetic Peptide
GQQSDLEQERL

SEQ ID NO: 292 - protein, 8 aa, Unknown
  Synthetic Peptide
GVSENIFL

SEQ ID NO: 293 - protein, 9 aa, Unknown
  Synthetic Peptide
HIFDGDNEI

SEQ ID NO: 294 - protein, 10 aa, Unknown
  Synthetic Peptide
HIFDGDNEIL

SEQ ID NO: 295 - protein, 11 aa, Unknown
  Synthetic Peptide
HIKKYKNDKQV

SEQ ID NO: 296 - protein, 10 aa, Unknown
  Synthetic Peptide
HILYISFYFI

SEQ ID NO: 297 - protein, 11 aa, Unknown
  Synthetic Peptide
HILYISFYFIL

SEQ ID NO: 298 - protein, 10 aa, Unknown
  Synthetic Peptide
HLEEKKDGSI

SEQ ID NO: 299 - protein, 8 aa, Unknown
  Synthetic Peptide
HTLETVNI

SEQ ID NO: 300 - protein, 11 aa, Unknown
  Synthetic Peptide
HTLETVNISDV

SEQ ID NO: 301 - protein, 11 aa, Unknown
  Synthetic Peptide
HVLSHNSYEKT

SEQ ID NO: 302 - protein, 10 aa, Unknown
  Synthetic Peptide
IIEKTNRESI

SEQ ID NO: 303 - protein, 11 aa, Unknown
  Synthetic Peptide
IIEKTNRESIT

SEQ ID NO: 304 - protein, 10 aa, Unknown
  Synthetic Peptide
IIKNSEKDEI

SEQ ID NO: 305 - protein, 11 aa, Unknown
  Synthetic Peptide
IIKNSEKDEII

SEQ ID NO: 306 - protein, 8 aa, Unknown
  Synthetic Peptide
ILQIVDEL

SEQ ID NO: 307 - protein, 10 aa, Unknown
  Synthetic Peptide
ILVNLLIFHI

SEQ ID NO: 308 - protein, 9 aa, Unknown
  Synthetic Peptide
ILYISFYFI

SEQ ID NO: 309 - protein, 10 aa, Unknown
  Synthetic Peptide
ILYISFYFIL

SEQ ID NO: 310 - protein, 11 aa, Unknown
  Synthetic Peptide
ILYISFYFILV

SEQ ID NO: 311 - protein, 8 aa, Unknown
  Synthetic Peptide
IQNHTLET

SEQ ID NO: 312 - protein, 9 aa, Unknown
  Synthetic Peptide
IQNHTLETV

SEQ ID NO: 313 - protein, 11 aa, Unknown
  Synthetic Peptide
IQNHTLETVNI

SEQ ID NO: 314 - protein, 8 aa, Unknown
  Synthetic Peptide
ITKYFMKL

SEQ ID NO: 315 - protein, 11 aa, Unknown
  Synthetic Peptide
ITTNVEGRRDI

SEQ ID NO: 316 - protein, 9 aa, Unknown
  Synthetic Peptide
IVDELSEDI

SEQ ID NO: 317 - protein, 10 aa, Unknown
  Synthetic Peptide
IVDELSEDIT

SEQ ID NO: 318 - protein, 8 aa, Unknown
  Synthetic Peptide
KADTKKNL

SEQ ID NO: 319 - protein, 11 aa, Unknown
  Synthetic Peptide
KIIKNSEKDEI

SEQ ID NO: 320 - protein, 11 aa, Unknown
  Synthetic Peptide
KIKKGKKYEKT

SEQ ID NO: 321 - protein, 8 aa, Unknown
  Synthetic Peptide
KLNKEGKL

SEQ ID NO: 322 - protein, 9 aa, Unknown
  Synthetic Peptide
KLNKEGKLI

SEQ ID NO: 323 - protein, 9 aa, Unknown
  Synthetic Peptide
KLQEQQRDL

SEQ ID NO: 324 - protein, 9 aa, Unknown
  Synthetic Peptide
KLQEQQSDL

SEQ ID NO: 325 - protein, 9 aa, Unknown
  Synthetic Peptide
KLQGQQSDL

SEQ ID NO: 326 - protein, 11 aa, Unknown
  Synthetic Peptide
KQVNKEKEKFI

SEQ ID NO: 327 - protein, 8 aa, Unknown
  Synthetic Peptide
KTNRESIT

SEQ ID NO: 328 - protein, 9 aa, Unknown
  Synthetic Peptide
KTNRESITT

SEQ ID NO: 329 - protein, 11 aa, Unknown
  Synthetic Peptide
KTNRESITTNV

SEQ ID NO: 330 - protein, 9 aa, Unknown
  Synthetic Peptide
LAEDLYGRL

SEQ ID NO: 331 - protein, 11 aa, Unknown
  Synthetic Peptide
LAEDLYGRLEI

SEQ ID NO: 332 - protein, 11 aa, Unknown
  Synthetic Peptide
LIDEEEDDEDL

SEQ ID NO: 333 - protein, 8 aa, Unknown
  Synthetic Peptide
LIEKNENL

SEQ ID NO: 334 - protein, 11 aa, Unknown
  Synthetic Peptide
LIEKNENLDDL

SEQ ID NO: 335 - protein, 9 aa, Unknown
  Synthetic Peptide
LIFHINGKI

SEQ ID NO: 336 - protein, 10 aa, Unknown
  Synthetic Peptide
LIFHINGKII

SEQ ID NO: 337 - protein, 10 aa, Unknown
  Synthetic Peptide
LLIFHINGKI

SEQ ID NO: 338 - protein, 11 aa, Unknown
  Synthetic Peptide
LLIFHINGKII

SEQ ID NO: 339 - protein, 11 aa, Unknown
  Synthetic Peptide
LLRNLGVSENI

SEQ ID NO: 340 - protein, 8 aa, Unknown
  Synthetic Peptide
LQEQQRDL

SEQ ID NO: 341 - protein, 8 aa, Unknown
  Synthetic Peptide
LQEQQSDL

SEQ ID NO: 342 - protein, 11 aa, Unknown
  Synthetic Peptide
LQEQQSDLERT

SEQ ID NO: 343 - protein, 8 aa, Unknown
  Synthetic Peptide
LQGQQSDL

SEQ ID NO: 344 - protein, 11 aa, Unknown
  Synthetic Peptide
LQIVDELSEDI

SEQ ID NO: 345 - protein, 9 aa, Unknown
  Synthetic Peptide
LTMSNVKNV

SEQ ID NO: 346 - protein, 9 aa, Unknown
  Synthetic Peptide
LVNLLIFHI

SEQ ID NO: 347 - protein, 9 aa, Unknown
  Synthetic Peptide
NIFLKENKL

SEQ ID NO: 348 - protein, 8 aa, Unknown
  Synthetic Peptide
NIGIYKEL

SEQ ID NO: 349 - protein, 11 aa, Unknown
  Synthetic Peptide
NIGIYKELEDL

SEQ ID NO: 350 - protein, 10 aa, Unknown
  Synthetic Peptide
NISDVNDFQI

SEQ ID NO: 351 - protein, 9 aa, Unknown
  Synthetic Peptide
NLDDLDEGI

SEQ ID NO: 352 - protein, 11 aa, Unknown
  Synthetic Peptide
NLERKKEHGDV

SEQ ID NO: 353 - protein, 8 aa, Unknown
  Synthetic Peptide
NLGVSENI

SEQ ID NO: 354 - protein, 10 aa, Unknown
  Synthetic Peptide
NLGVSENIFL

SEQ ID NO: 355 - protein, 11 aa, Unknown
  Synthetic Peptide
NLLIFHINGKI

SEQ ID NO: 356 - protein, 8 aa, Unknown
  Synthetic Peptide
NVEGRRDI

SEQ ID NO: 357 - protein, 8 aa, Unknown
  Synthetic Peptide
NVKNVSQT

SEQ ID NO: 358 - protein, 10 aa, Unknown
  Synthetic Peptide
NVSQTNFKSL

SEQ ID NO: 359 - protein, 11 aa, Unknown
  Synthetic Peptide
NVSQTNFKSLL

SEQ ID NO: 360 - protein, 9 aa, Unknown
  Synthetic Peptide
QISKYEDEI

SEQ ID NO: 361 - protein, 11 aa, Unknown
  Synthetic Peptide
QISKYEDEISA

SEQ ID NO: 362 - protein, 10 aa, Unknown
  Synthetic Peptide
QIVDELSEDI

SEQ ID NO: 363 - protein, 11 aa, Unknown
  Synthetic Peptide
QIVDELSEDIT

SEQ ID NO: 364 - protein, 10 aa, Unknown
  Synthetic Peptide
QQRDLEQERL

SEQ ID NO: 365 - protein, 11 aa, Unknown
  Synthetic Peptide
QQRDLEQERLA

SEQ ID NO: 366 - protein, 11 aa, Unknown
  Synthetic Peptide
QQRDLEQERRA

SEQ ID NO: 367 - protein, 10 aa, Unknown
  Synthetic Peptide
QQRDLEQRKA

SEQ ID NO: 368 - protein, 10 aa, Unknown
  Synthetic Peptide
QQSDLEQDRL

SEQ ID NO: 369 - protein, 11 aa, Unknown
  Synthetic Peptide
QQSDLEQDRLA

SEQ ID NO: 370 - protein, 10 aa, Unknown
  Synthetic Peptide
QQSDLEQERL

SEQ ID NO: 371 - protein, 11 aa, Unknown
  Synthetic Peptide
QQSDLEQERLA

SEQ ID NO: 372 - protein, 11 aa, Unknown
  Synthetic Peptide
QQSDLEQERRA

SEQ ID NO: 373 - protein, 8 aa, Unknown
  Synthetic Peptide
QQSDLERT

SEQ ID NO: 374 - protein, 10 aa, Unknown
  Synthetic Peptide
QQSDLERTKA

SEQ ID NO: 375 - protein, 10 aa, Unknown
  Synthetic Peptide
QQSDSEQERL

SEQ ID NO: 376 - protein, 11 aa, Unknown
  Synthetic Peptide
QQSDSEQERLA

SEQ ID NO: 377 - protein, 8 aa, Unknown
  Synthetic Peptide
QTNFKSLL

SEQ ID NO: 378 - protein, 11 aa, Unknown
  Synthetic Peptide
QTNFKSLLRNL

SEQ ID NO: 379 - protein, 10 aa, Unknown
  Synthetic Peptide
QVNKEKEKFI

SEQ ID NO: 380 - protein, 9 aa, Unknown
  Synthetic Peptide
RLEIPAIEL

SEQ ID NO: 381 - protein, 9 aa, Unknown
  Synthetic Peptide
RQEDLEEKA

SEQ ID NO: 382 - protein, 10 aa, Unknown
  Synthetic Peptide
RQEDLEEKAA

SEQ ID NO: 383 - protein, 8 aa, Unknown
  Synthetic Peptide
RTKASKET

SEQ ID NO: 384 - protein, 9 aa, Unknown
  Synthetic Peptide
RTKASKETL

SEQ ID NO: 385 - protein, 8 aa, Unknown
  Synthetic Peptide
SADIQNHT

SEQ ID NO: 386 - protein, 9 aa, Unknown
  Synthetic Peptide
SADIQNHTL

SEQ ID NO: 387 - protein, 11 aa, Unknown
  Synthetic Peptide
SADIQNHTLET

SEQ ID NO: 388 - protein, 8 aa, Unknown
  Synthetic Peptide
SAEYDDSL

SEQ ID NO: 389 - protein, 9 aa, Unknown
  Synthetic Peptide
SAEYDDSLI

SEQ ID NO: 390 - protein, 11 aa, Unknown
  Synthetic Peptide
SIIEKTNRESI

SEQ ID NO: 391 - protein, 8 aa, Unknown
  Synthetic Peptide
SLLRNLGV

SEQ ID NO: 392 - protein, 8 aa, Unknown
  Synthetic Peptide
SQTNFKSL

SEQ ID NO: 393 - protein, 9 aa, Unknown
  Synthetic Peptide
SQTNFKSLL

SEQ ID NO: 394 - protein, 10 aa, Unknown
  Synthetic Peptide
TLETVNISDV

SEQ ID NO: 395 - protein, 9 aa, Unknown
  Synthetic Peptide
TLQEQQSDL

SEQ ID NO: 396 - protein, 9 aa, Unknown
  Synthetic Peptide
TLQGQQSDL

SEQ ID NO: 397 - protein, 8 aa, Unknown
  Synthetic Peptide
TMSNVKNV

SEQ ID NO: 398 - protein, 11 aa, Unknown
  Synthetic Peptide
TMSNVKNVSQT

SEQ ID NO: 399 - protein, 10 aa, Unknown
  Synthetic Peptide
TTNVEGRRDI

SEQ ID NO: 400 - protein, 10 aa, Unknown
  Synthetic Peptide
VLAEDLYGRL

SEQ ID NO: 401 - protein, 10 aa, Unknown
  Synthetic Peptide
VLSHNSYEKT

SEQ ID NO: 402 - protein, 8 aa, Unknown
  Synthetic Peptide
YIPHQSSL

SEQ ID NO: 403 - protein, 8 aa, Unknown
  Synthetic Peptide
YISFYFIL

SEQ ID NO: 404 - protein, 9 aa, Unknown
  Synthetic Peptide
YISFYFILV

SEQ ID NO: 405 - protein, 11 aa, Unknown
  Synthetic Peptide
YISFYFILVNL

SEQ ID NO: 406 - protein, 10 aa, Unknown
  Synthetic Peptide
AATPYAGEPA

SEQ ID NO: 407 - protein, 9 aa, Unknown
  Synthetic Peptide
ATPYAGEPA

SEQ ID NO: 408 - protein, 11 aa, Unknown
  Synthetic Peptide
EILHEGCTSEL

SEQ ID NO: 409 - protein, 9 aa, Unknown
  Synthetic Peptide
EVCNDEVDL

SEQ ID NO: 410 - protein, 11 aa, Unknown
  Synthetic Peptide
EVCNDEVDLYL

SEQ ID NO: 411 - protein, 8 aa, Unknown
  Synthetic Peptide
EVDLYLLM

SEQ ID NO: 412 - protein, 11 aa, Unknown
  Synthetic Peptide
FVVPGAATPYA

SEQ ID NO: 413 - protein, 11 aa, Unknown
  Synthetic Peptide
GAATPYAGEPA

SEQ ID NO: 414 - protein, 10 aa, Unknown
  Synthetic Peptide
ILHEGCTSEL

SEQ ID NO: 415 - protein, 11 aa, Unknown
  Synthetic Peptide
LLSTNLPYGRT

SEQ ID NO: 416 - protein, 9 aa, Unknown
  Synthetic Peptide
NLPYGRTNL

SEQ ID NO: 417 - protein, 11 aa, Unknown
  Synthetic Peptide
SIRRHNWVNHA

SEQ ID NO: 418 - protein, 9 aa, Unknown
  Synthetic Peptide
STNLPYGRT

SEQ ID NO: 419 - protein, 11 aa, Unknown
  Synthetic Peptide
STNLPYGRTNL

SEQ ID NO: 420 - protein, 10 aa, Unknown
  Synthetic Peptide
VVPGAATPYA

SEQ ID NO: 421 - protein, 8 aa, Unknown
  Synthetic Peptide
WVNHAVPL

SEQ ID NO: 422 - protein, 9 aa, Unknown
  Synthetic Peptide
WVNHAVPLA

SEQ ID NO: 423 - protein, 10 aa, Unknown
  Synthetic Peptide
WVNHAVPLAM

SEQ ID NO: 424 - protein, 11 aa, Unknown
  Synthetic Peptide
YAGEPAPFDET

SEQ ID NO: 425 - protein, 9 aa, Unknown
  Synthetic Peptide
ALLQVRKHL

SEQ ID NO: 426 - protein, 10 aa, Unknown
  Synthetic Peptide
DALLQVRKHL

SEQ ID NO: 427 - protein, 11 aa, Unknown
  Synthetic Peptide
DASKNKEKALI

SEQ ID NO: 428 - protein, 11 aa, Unknown
  Synthetic Peptide
DQPRPRGDNFA

SEQ ID NO: 429 - protein, 8 aa, Unknown
  Synthetic Peptide
EIKYREEV

SEQ ID NO: 430 - protein, 11 aa, Unknown
  Synthetic Peptide
IQDSLKESRKL

SEQ ID NO: 431 - protein, 11 aa, Unknown
  Synthetic Peptide
IVDEIKYREEV

SEQ ID NO: 432 - protein, 8 aa, Unknown
  Synthetic Peptide
LLQVRKHL

SEQ ID NO: 433 - protein, 11 aa, Unknown
  Synthetic Peptide
LQVRKHLNDRI

SEQ ID NO: 434 - protein, 10 aa, Unknown
  Synthetic Peptide
QVRKHLNDRI

SEQ ID NO: 435 - protein, 8 aa, Unknown
  Synthetic Peptide
SLKESRKL

SEQ ID NO: 436 - protein, 8 aa, Unknown
  Synthetic Peptide
ALLACAGL

SEQ ID NO: 437 - protein, 9 aa, Unknown
  Synthetic Peptide
ALLACAGLA

SEQ ID NO: 438 - protein, 8 aa, Unknown
  Synthetic Peptide
AMKLIQQL

SEQ ID NO: 439 - protein, 10 aa, Unknown
  Synthetic Peptide
AMKLIQQLNL

SEQ ID NO: 440 - protein, 9 aa, Unknown
  Synthetic Peptide
AVCVEVEKT

SEQ ID NO: 441 - protein, 10 aa, Unknown
  Synthetic Peptide
AVCVEVEKTA

SEQ ID NO: 442 - protein, 9 aa, Unknown
  Synthetic Peptide
AVFGIGQGI

SEQ ID NO: 443 - protein, 11 aa, Unknown
  Synthetic Peptide
AVFGIGQGINV

SEQ ID NO: 444 - protein, 8 aa, Unknown
  Synthetic Peptide
AVPLAMKL

SEQ ID NO: 445 - protein, 9 aa, Unknown
  Synthetic Peptide
AVPLAMKLI

SEQ ID NO: 446 - protein, 9 aa, Unknown
  Synthetic Peptide
CAGLAYKFV

SEQ ID NO: 447 - protein, 10 aa, Unknown
  Synthetic Peptide
CAGLAYKFVV

SEQ ID NO: 448 - protein, 8 aa, Unknown
  Synthetic Peptide
CVEVEKTA

SEQ ID NO: 449 - protein, 9 aa, Unknown
  Synthetic Peptide
DASKNKEKA

SEQ ID NO: 450 - protein, 10 aa, Unknown
  Synthetic Peptide
DASKNKEKAL

SEQ ID NO: 451 - protein, 10 aa, Unknown
  Synthetic Peptide
DLDEPEQFRL

SEQ ID NO: 452 - protein, 10 aa, Unknown
  Synthetic Peptide
DLFLVNGRDV

SEQ ID NO: 453 - protein, 10 aa, Unknown
  Synthetic Peptide
DVQNNIVDEI

SEQ ID NO: 454 - protein, 9 aa, Unknown
  Synthetic Peptide
EIIRLHSDA

SEQ ID NO: 455 - protein, 8 aa, Unknown
  Synthetic Peptide
EILHEGCT

SEQ ID NO: 456 - protein, 10 aa, Unknown
  Synthetic Peptide
ETLGEEDKDL

SEQ ID NO: 457 - protein, 10 aa, Unknown
  Synthetic Peptide
EVEKTASCGV

SEQ ID NO: 458 - protein, 9 aa, Unknown
  Synthetic Peptide
FLIFFDLFL

SEQ ID NO: 459 - protein, 10 aa, Unknown
  Synthetic Peptide
FLIFFDLFLV

SEQ ID NO: 460 - protein, 8 aa, Unknown
  Synthetic Peptide
FLVNGRDV

SEQ ID NO: 461 - protein, 9 aa, Unknown
  Synthetic Peptide
FMKAVCVEV

SEQ ID NO: 462 - protein, 8 aa, Unknown
  Synthetic Peptide
FVVPGAAT

SEQ ID NO: 463 - protein, 8 aa, Unknown
  Synthetic Peptide
GIAGGLAL

SEQ ID NO: 464 - protein, 9 aa, Unknown
  Synthetic Peptide
GIAGGLALL

SEQ ID NO: 465 - protein, 10 aa, Unknown
  Synthetic Peptide
GIAGGLALLA

SEQ ID NO: 466 - protein, 8 aa, Unknown
  Synthetic Peptide
GIGQGINV

SEQ ID NO: 467 - protein, 9 aa, Unknown
  Synthetic Peptide
GIGQGINVA

SEQ ID NO: 468 - protein, 10 aa, Unknown
  Synthetic Peptide
GINVAFNRFL

SEQ ID NO: 469 - protein, 11 aa, Unknown
  Synthetic Peptide
GINVAFNRFLV

SEQ ID NO: 470 - protein, 10 aa, Unknown
  Synthetic Peptide
GIPDSIQDSL

SEQ ID NO: 471 - protein, 8 aa, Unknown
  Synthetic Peptide
GLALLACA

SEQ ID NO: 472 - protein, 10 aa, Unknown
  Synthetic Peptide
GLALLACAGL

SEQ ID NO: 473 - protein, 11 aa, Unknown
  Synthetic Peptide
GLALLACAGLA

SEQ ID NO: 474 - protein, 8 aa, Unknown
  Synthetic Peptide
GLAYKFVV

SEQ ID NO: 475 - protein, 11 aa, Unknown
  Synthetic Peptide
GLAYKFVVPGA

SEQ ID NO: 476 - protein, 9 aa, Unknown
  Synthetic Peptide
GTRSRKREI

SEQ ID NO: 477 - protein, 10 aa, Unknown
  Synthetic Peptide
GTRSRKREIL

SEQ ID NO: 478 - protein, 9 aa, Unknown
  Synthetic Peptide
GVKIAVFGI

SEQ ID NO: 479 - protein, 11 aa, Unknown
  Synthetic Peptide
GVWDEWSPCSV

SEQ ID NO: 480 - protein, 9 aa, Unknown
  Synthetic Peptide
HAVPLAMKL

SEQ ID NO: 481 - protein, 10 aa, Unknown
  Synthetic Peptide
HAVPLAMKLI

SEQ ID NO: 482 - protein, 8 aa, Unknown
  Synthetic Peptide
HLGNVKYL

SEQ ID NO: 483 - protein, 9 aa, Unknown
  Synthetic Peptide
HLGNVKYLV

SEQ ID NO: 484 - protein, 10 aa, Unknown
  Synthetic Peptide
HLGNVKYLVI

SEQ ID NO: 485 - protein, 11 aa, Unknown
  Synthetic Peptide
HLGNVKYLVIV

SEQ ID NO: 486 - protein, 11 aa, Unknown
  Synthetic Peptide
HLNDRINRENA

SEQ ID NO: 487 - protein, 10 aa, Unknown
  Synthetic Peptide
HVPNSEDRET

SEQ ID NO: 488 - protein, 9 aa, Unknown
  Synthetic Peptide
IAGGIAGGL

SEQ ID NO: 489 - protein, 10 aa, Unknown
  Synthetic Peptide
IAGGIAGGLA

SEQ ID NO: 490 - protein, 11 aa, Unknown
  Synthetic Peptide
IAGGIAGGLAL

SEQ ID NO: 491 - protein, 8 aa, Unknown
  Synthetic Peptide
IAGGLALL

SEQ ID NO: 492 - protein, 9 aa, Unknown
  Synthetic Peptide
IAGGLALLA

SEQ ID NO: 493 - protein, 11 aa, Unknown
  Synthetic Peptide
IAGGLALLACA

SEQ ID NO: 494 - protein, 10 aa, Unknown
  Synthetic Peptide
IAVFGIGQGI

SEQ ID NO: 495 - protein, 8 aa, Unknown
  Synthetic Peptide
IIRLHSDA

SEQ ID NO: 496 - protein, 10 aa, Unknown
  Synthetic Peptide
ILTDGIPDSI

SEQ ID NO: 497 - protein, 9 aa, Unknown
  Synthetic Peptide
IVFLIFFDL

SEQ ID NO: 498 - protein, 11 aa, Unknown
  Synthetic Peptide
IVFLIFFDLFL

SEQ ID NO: 499 - protein, 10 aa, Unknown
  Synthetic Peptide
KAVCVEVEKT

SEQ ID NO: 500 - protein, 11 aa, Unknown
  Synthetic Peptide
KAVCVEVEKTA

SEQ ID NO: 501 - protein, 10 aa, Unknown
  Synthetic Peptide
KIAGGIAGGL

SEQ ID NO: 502 - protein, 11 aa, Unknown
  Synthetic Peptide
KIAGGIAGGLA

SEQ ID NO: 503 - protein, 11 aa, Unknown
  Synthetic Peptide
KIAVFGIGQGI

SEQ ID NO: 504 - protein, 8 aa, Unknown
  Synthetic Peptide
KLIQQLNL

SEQ ID NO: 505 - protein, 11 aa, Unknown
  Synthetic Peptide
LACAGLAYKFV

SEQ ID NO: 506 - protein, 9 aa, Unknown
  Synthetic Peptide
LALLACAGL

SEQ ID NO: 507 - protein, 10 aa, Unknown
  Synthetic Peptide
LALLACAGLA

SEQ ID NO: 508 - protein, 9 aa, Unknown
  Synthetic Peptide
LAMKLIQQL

SEQ ID NO: 509 - protein, 11 aa, Unknown
  Synthetic Peptide
LAMKLIQQLNL

SEQ ID NO: 510 - protein, 10 aa, Unknown
  Synthetic Peptide
LAYKFVVPGA

SEQ ID NO: 511 - protein, 11 aa, Unknown
  Synthetic Peptide
LAYKFVVPGAA

SEQ ID NO: 512 - protein, 8 aa, Unknown
  Synthetic Peptide
LIFFDLFL

SEQ ID NO: 513 - protein, 9 aa, Unknown
  Synthetic Peptide
LIFFDLFLV

SEQ ID NO: 514 - protein, 8 aa, Unknown
  Synthetic Peptide
LLACAGLA

SEQ ID NO: 515 - protein, 9 aa, Unknown
  Synthetic Peptide
LLMDCSGSI

SEQ ID NO: 516 - protein, 8 aa, Unknown
  Synthetic Peptide
LMDCSGSI

SEQ ID NO: 517 - protein, 9 aa, Unknown
  Synthetic Peptide
LTDGIPDSI

SEQ ID NO: 518 - protein, 11 aa, Unknown
  Synthetic Peptide
LVIVFLIFFDL

SEQ ID NO: 519 - protein, 11 aa, Unknown
  Synthetic Peptide
LVNGRDVQNNI

SEQ ID NO: 520 - protein, 9 aa, Unknown
  Synthetic Peptide
LVVILTDGI

SEQ ID NO: 521 - protein, 8 aa, Unknown
  Synthetic Peptide
NANQLVVI

SEQ ID NO: 522 - protein, 9 aa, Unknown
  Synthetic Peptide
NANQLVVIL

SEQ ID NO: 523 - protein, 10 aa, Unknown
  Synthetic Peptide
NANQLVVILT

SEQ ID NO: 524 - protein, 10 aa, Unknown
  Synthetic Peptide
NIPEDSEKEV

SEQ ID NO: 525 - protein, 11 aa, Unknown
  Synthetic Peptide
NLYADSAWENV

SEQ ID NO: 526 - protein, 8 aa, Unknown
  Synthetic Peptide
NQLVVILT

SEQ ID NO: 527 - protein, 11 aa, Unknown
  Synthetic Peptide
NQLVVILTDGI

SEQ ID NO: 528 - protein, 8 aa, Unknown
  Synthetic Peptide
NVAFNRFL

SEQ ID NO: 529 - protein, 9 aa, Unknown
  Synthetic Peptide
NVAFNRFLV

SEQ ID NO: 530 - protein, 9 aa, Unknown
  Synthetic Peptide
NVIGPFMKA

SEQ ID NO: 531 - protein, 10 aa, Unknown
  Synthetic Peptide
NVIGPFMKAV

SEQ ID NO: 532 - protein, 10 aa, Unknown
  Synthetic Peptide
NVKNVIGPFM

SEQ ID NO: 533 - protein, 8 aa, Unknown
  Synthetic Peptide
NVKYLVIV

SEQ ID NO: 534 - protein, 10 aa, Unknown
  Synthetic Peptide
NVKYLVIVFL

SEQ ID NO: 535 - protein, 11 aa, Unknown
  Synthetic Peptide
NVKYLVIVFLI

SEQ ID NO: 536 - protein, 8 aa, Unknown
  Synthetic Peptide
PAPFDETL

SEQ ID NO: 537 - protein, 10 aa, Unknown
  Synthetic Peptide
PLAMKLIQQL

SEQ ID NO: 538 - protein, 10 aa, Unknown
  Synthetic Peptide
QLVVILTDGI

SEQ ID NO: 539 - protein, 10 aa, Unknown
  Synthetic Peptide
RINRENANQL

SEQ ID NO: 540 - protein, 11 aa, Unknown
  Synthetic Peptide
RINRENANQLV

SEQ ID NO: 541 - protein, 9 aa, Unknown
  Synthetic Peptide
SAWENVKNV

SEQ ID NO: 542 - protein, 10 aa, Unknown
  Synthetic Peptide
SAWENVKNVI

SEQ ID NO: 543 - protein, 8 aa, Unknown
  Synthetic Peptide
SIRRHNWV

SEQ ID NO: 544 - protein, 10 aa, Unknown
  Synthetic Peptide
SQDNNGNRHV

SEQ ID NO: 545 - protein, 8 aa, Unknown
  Synthetic Peptide
SVTCGKGT

SEQ ID NO: 546 - protein, 9 aa, Unknown
  Synthetic Peptide
TLGEEDKDL

SEQ ID NO: 547 - protein, 8 aa, Unknown
  Synthetic Peptide
VAFNRFLV

SEQ ID NO: 548 - protein, 8 aa, Unknown
  Synthetic Peptide
VIGPFMKA

SEQ ID NO: 549 - protein, 9 aa, Unknown
  Synthetic Peptide
VIGPFMKAV

SEQ ID NO: 550 - protein, 11 aa, Unknown
  Synthetic Peptide
VIGPFMKAVCV

SEQ ID NO: 551 - protein, 11 aa, Unknown
  Synthetic Peptide
VILTDGIPDSI

SEQ ID NO: 552 - protein, 10 aa, Unknown
  Synthetic Peptide
VIVFLIFFDL

SEQ ID NO: 553 - protein, 9 aa, Unknown
  Synthetic Peptide
VQNNIVDEI

SEQ ID NO: 554 - protein, 8 aa, Unknown
  Synthetic Peptide
VVILTDGI

SEQ ID NO: 555 - protein, 9 aa, Unknown
  Synthetic Peptide
YADSAWENV

SEQ ID NO: 556 - protein, 10 aa, Unknown
  Synthetic Peptide
YLLMDCSGSI

SEQ ID NO: 557 - protein, 8 aa, Unknown
  Synthetic Peptide
YLVIVFLI

SEQ ID NO: 558 - protein, 8 aa, Unknown
  Synthetic Peptide
DIEKKICK

SEQ ID NO: 559 - protein, 11 aa, Unknown
  Synthetic Peptide
DIEKKICKMEK

SEQ ID NO: 560 - protein, 9 aa, Unknown
  Synthetic Peptide
ELEMNYYGK

SEQ ID NO: 561 - protein, 8 aa, Unknown
  Synthetic Peptide
KLRKPKHK

SEQ ID NO: 562 - protein, 9 aa, Unknown
  Synthetic Peptide
KLRKPKHKK

SEQ ID NO: 563 - protein, 11 aa, Unknown
  Synthetic Peptide
KLRKPKHKKLK

SEQ ID NO: 564 - protein, 9 aa, Unknown
  Synthetic Peptide
NANANNAVK

SEQ ID NO: 565 - protein, 10 aa, Unknown
  Synthetic Peptide
NANPNANPNK

SEQ ID NO: 566 - protein, 8 aa, Unknown
  Synthetic Peptide
NMPNDPNR

SEQ ID NO: 567 - protein, 11 aa, Unknown
  Synthetic Peptide
SVTCGNGIQVR

SEQ ID NO: 568 - protein, 10 aa, Unknown
  Synthetic Peptide
VTCGNGIQVR

SEQ ID NO: 569 - protein, 8 aa, Unknown
  Synthetic Peptide
YSLKKNSR

SEQ ID NO: 570 - protein, 9 aa, Unknown
  Synthetic Peptide
ALFFIIFNK

SEQ ID NO: 571 - protein, 8 aa, Unknown
  Synthetic Peptide
DLISDMIK

SEQ ID NO: 572 - protein, 9 aa, Unknown
  Synthetic Peptide
DLISDMIKK

SEQ ID NO: 573 - protein, 11 aa, Unknown
  Synthetic Peptide
DVHDLISDMIK

SEQ ID NO: 574 - protein, 8 aa, Unknown
  Synthetic Peptide
ELVEVNKR

SEQ ID NO: 575 - protein, 9 aa, Unknown
  Synthetic Peptide
ELVEVNKRK

SEQ ID NO: 576 - protein, 11 aa, Unknown
  Synthetic Peptide
ELVEVNKRKSK

SEQ ID NO: 577 - protein, 9 aa, Unknown
  Synthetic Peptide
ESLAEKTNK

SEQ ID NO: 578 - protein, 8 aa, Unknown
  Synthetic Peptide
EVNKRKSK

SEQ ID NO: 579 - protein, 10 aa, Unknown
  Synthetic Peptide
EVNKRKSKYK

SEQ ID NO: 580 - protein, 11 aa, Unknown
  Synthetic Peptide
FLALFFIIFNK

SEQ ID NO: 581 - protein, 9 aa, Unknown
  Synthetic Peptide
GLVLYNTEK

SEQ ID NO: 582 - protein, 11 aa, Unknown
  Synthetic Peptide
GLVLYNTEKGR

SEQ ID NO: 583 - protein, 8 aa, Unknown
  Synthetic Peptide
GSGVSSKK

SEQ ID NO: 584 - protein, 9 aa, Unknown
  Synthetic Peptide
GSGVSSKKK

SEQ ID NO: 585 - protein, 11 aa, Unknown
  Synthetic Peptide
GSGVSSKKKNK

SEQ ID NO: 586 - protein, 9 aa, Unknown
  Synthetic Peptide
GTGSGVSSK

SEQ ID NO: 587 - protein, 10 aa, Unknown
  Synthetic Peptide
GTGSGVSSKK

SEQ ID NO: 588 - protein, 11 aa, Unknown
  Synthetic Peptide
GTGSGVSSKKK

SEQ ID NO: 589 - protein, 11 aa, Unknown
  Synthetic Peptide
GVGLVLYNTEK

SEQ ID NO: 590 - protein, 9 aa, Unknown
  Synthetic Peptide
GVSSKKKNK

SEQ ID NO: 591 - protein, 10 aa, Unknown
  Synthetic Peptide
GVSSKKKNKK

SEQ ID NO: 592 - protein, 11 aa, Unknown
  Synthetic Peptide
IIFNKESLAEK

SEQ ID NO: 593 - protein, 10 aa, Unknown
  Synthetic Peptide
LALFFIIFNK

SEQ ID NO: 594 - protein, 8 aa, Unknown
  Synthetic Peptide
LISDMIKK

SEQ ID NO: 595 - protein, 8 aa, Unknown
  Synthetic Peptide
LVEVNKRK

SEQ ID NO: 596 - protein, 10 aa, Unknown
  Synthetic Peptide
LVEVNKRKSK

SEQ ID NO: 597 - protein, 8 aa, Unknown
  Synthetic Peptide
LVLYNTEK

SEQ ID NO: 598 - protein, 10 aa, Unknown
  Synthetic Peptide
LVLYNTEKGR

SEQ ID NO: 599 - protein, 10 aa, Unknown
  Synthetic Peptide
NTEKGRHPFK

SEQ ID NO: 600 - protein, 8 aa, Unknown
  Synthetic Peptide
SLAEKTNK

SEQ ID NO: 601 - protein, 8 aa, Unknown
  Synthetic Peptide
SSKKKNKK

SEQ ID NO: 602 - protein, 9 aa, Unknown
  Synthetic Peptide
VLYNTEKGR

SEQ ID NO: 603 - protein, 8 aa, Unknown
  Synthetic Peptide
VSSKKKNK

SEQ ID NO: 604 - protein, 9 aa, Unknown
  Synthetic Peptide
VSSKKKNKK

SEQ ID NO: 605 - protein, 10 aa, Unknown
  Synthetic Peptide
AIELPSENER

SEQ ID NO: 606 - protein, 10 aa, Unknown
  Synthetic Peptide
DIHKGHLEEK

SEQ ID NO: 607 - protein, 11 aa, Unknown
  Synthetic Peptide
DIHKGHLEEKK

SEQ ID NO: 608 - protein, 8 aa, Unknown
  Synthetic Peptide
DITKYFMK

SEQ ID NO: 609 - protein, 8 aa, Unknown
  Synthetic Peptide
DLDEGIEK

SEQ ID NO: 610 - protein, 8 aa, Unknown
  Synthetic Peptide
DLEEKAAK

SEQ ID NO: 611 - protein, 9 aa, Unknown
  Synthetic Peptide
DLEQDRLAK

SEQ ID NO: 612 - protein, 11 aa, Unknown
  Synthetic Peptide
DLEQDRLAKEK

SEQ ID NO: 613 - protein, 9 aa, Unknown
  Synthetic Peptide
DLEQERLAK

SEQ ID NO: 614 - protein, 11 aa, Unknown
  Synthetic Peptide
DLEQERLAKEK

SEQ ID NO: 615 - protein, 11 aa, Unknown
  Synthetic Peptide
DLEQERLANEK

SEQ ID NO: 616 - protein, 9 aa, Unknown
  Synthetic Peptide
DLEQERRAK

SEQ ID NO: 617 - protein, 11 aa, Unknown
  Synthetic Peptide
DLEQERRAKEK

SEQ ID NO: 618 - protein, 10 aa, Unknown
  Synthetic Peptide
DLEQRKADTK

SEQ ID NO: 619 - protein, 11 aa, Unknown
  Synthetic Peptide
DLEQRKADTKK

SEQ ID NO: 620 - protein, 9 aa, Unknown
  Synthetic Peptide
DLERTKASK

SEQ ID NO: 621 - protein, 9 aa, Unknown
  Synthetic Peptide
DSEQERLAK

SEQ ID NO: 622 - protein, 11 aa, Unknown
  Synthetic Peptide
DSEQERLAKEK

SEQ ID NO: 623 - protein, 10 aa, Unknown
  Synthetic Peptide
DSKEISIIEK

SEQ ID NO: 624 - protein, 8 aa, Unknown
  Synthetic Peptide
DTKKNLER

SEQ ID NO: 625 - protein, 9 aa, Unknown
  Synthetic Peptide
DTKKNLERK

SEQ ID NO: 626 - protein, 10 aa, Unknown
  Synthetic Peptide
DTKKNLERKK

SEQ ID NO: 627 - protein, 10 aa, Unknown
  Synthetic Peptide
DVLAEDLYGR

SEQ ID NO: 628 - protein, 9 aa, Unknown
  Synthetic Peptide
DVNDFQISK

SEQ ID NO: 629 - protein, 8 aa, Unknown
  Synthetic Peptide
EIIKSNLR

SEQ ID NO: 630 - protein, 10 aa, Unknown
  Synthetic Peptide
EISIIEKTNR

SEQ ID NO: 631 - protein, 8 aa, Unknown
  Synthetic Peptide
ELEDLIEK

SEQ ID NO: 632 - protein, 8 aa, Unknown
  Synthetic Peptide
ELPSENER

SEQ ID NO: 633 - protein, 8 aa, Unknown
  Synthetic Peptide
ELSEDITK

SEQ ID NO: 634 - protein, 8 aa, Unknown
  Synthetic Peptide
ELSEEKIK

SEQ ID NO: 635 - protein, 9 aa, Unknown
  Synthetic Peptide
ELSEEKIKK

SEQ ID NO: 636 - protein, 11 aa, Unknown
  Synthetic Peptide
ELSEEKIKKGK

SEQ ID NO: 637 - protein, 8 aa, Unknown
  Synthetic Peptide
ELTMSNVK

SEQ ID NO: 638 - protein, 10 aa, Unknown
  Synthetic Peptide
ESITTNVEGR

SEQ ID NO: 639 - protein, 11 aa, Unknown
  Synthetic Peptide
ESITTNVEGRR

SEQ ID NO: 640 - protein, 9 aa, Unknown
  Synthetic Peptide
FLKENKLNK

SEQ ID NO: 641 - protein, 8 aa, Unknown
  Synthetic Peptide
GSIKPEQK

SEQ ID NO: 642 - protein, 11 aa, Unknown
  Synthetic Peptide
GSIKPEQKEDK

SEQ ID NO: 643 - protein, 8 aa, Unknown
  Synthetic Peptide
GSSNSRNR

SEQ ID NO: 644 - protein, 9 aa, Unknown
  Synthetic Peptide
GVSENIFLK

SEQ ID NO: 645 - protein, 9 aa, Unknown
  Synthetic Peptide
HIINDDDDK

SEQ ID NO: 646 - protein, 10 aa, Unknown
  Synthetic Peptide
HIINDDDDKK

SEQ ID NO: 647 - protein, 11 aa, Unknown
  Synthetic Peptide
HIINDDDDKKK

SEQ ID NO: 648 - protein, 9 aa, Unknown
  Synthetic Peptide
HIKKYKNDK

SEQ ID NO: 649 - protein, 8 aa, Unknown
  Synthetic Peptide
HINGKIIK

SEQ ID NO: 650 - protein, 11 aa, Unknown
  Synthetic Peptide
HLEEKKDGSIK

SEQ ID NO: 651 - protein, 10 aa, Unknown
  Synthetic Peptide
HVLSHNSYEK

SEQ ID NO: 652 - protein, 8 aa, Unknown
  Synthetic Peptide
IINDDDDK

SEQ ID NO: 653 - protein, 9 aa, Unknown
  Synthetic Peptide
IINDDDDKK

SEQ ID NO: 654 - protein, 10 aa, Unknown
  Synthetic Peptide
IINDDDDKKK

SEQ ID NO: 655 - protein, 11 aa, Unknown
  Synthetic Peptide
ISDVNDFQISK

SEQ ID NO: 656 - protein, 9 aa, Unknown
  Synthetic Peptide
ISIIEKTNR

SEQ ID NO: 657 - protein, 8 aa, Unknown
  Synthetic Peptide
ITTNVEGR

SEQ ID NO: 658 - protein, 9 aa, Unknown
  Synthetic Peptide
ITTNVEGRR

SEQ ID NO: 659 - protein, 11 aa, Unknown
  Synthetic Peptide
IVDELSEDITK

SEQ ID NO: 660 - protein, 10 aa, Unknown
  Synthetic Peptide
KADTKKNLER

SEQ ID NO: 661 - protein, 11 aa, Unknown
  Synthetic Peptide
KADTKKNLERK

SEQ ID NO: 662 - protein, 8 aa, Unknown
  Synthetic Peptide
KIIKNSEK

SEQ ID NO: 663 - protein, 10 aa, Unknown
  Synthetic Peptide
KIKKGKKYEK

SEQ ID NO: 664 - protein, 11 aa, Unknown
  Synthetic Peptide
KLQEQQSDLER

SEQ ID NO: 665 - protein, 9 aa, Unknown
  Synthetic Peptide
KSLYDEHIK

SEQ ID NO: 666 - protein, 10 aa, Unknown
  Synthetic Peptide
KSLYDEHIKK

SEQ ID NO: 667 - protein, 10 aa, Unknown
  Synthetic Peptide
KSSEELSEEK

SEQ ID NO: 668 - protein, 8 aa, Unknown
  Synthetic Peptide
KTKDNNFK

SEQ ID NO: 669 - protein, 9 aa, Unknown
  Synthetic Peptide
KTKNNENNK

SEQ ID NO: 670 - protein, 8 aa, Unknown
  Synthetic Peptide
LAEDLYGR

SEQ ID NO: 671 - protein, 11 aa, Unknown
  Synthetic Peptide
LAKEKLQEQQR

SEQ ID NO: 672 - protein, 11 aa, Unknown
  Synthetic Peptide
LANEKLQEQQR

SEQ ID NO: 673 - protein, 8 aa, Unknown
  Synthetic Peptide
LIFHINGK

SEQ ID NO: 674 - protein, 11 aa, Unknown
  Synthetic Peptide
LIFHINGKIIK

SEQ ID NO: 675 - protein, 9 aa, Unknown
  Synthetic Peptide
LLIFHINGK

SEQ ID NO: 676 - protein, 11 aa, Unknown
  Synthetic Peptide
LSEDITKYFMK

SEQ ID NO: 677 - protein, 8 aa, Unknown
  Synthetic Peptide
LSEEKIKK

SEQ ID NO: 678 - protein, 10 aa, Unknown
  Synthetic Peptide
LSEEKIKKGK

SEQ ID NO: 679 - protein, 11 aa, Unknown
  Synthetic Peptide
LSEEKIKKGKK

SEQ ID NO: 680 - protein, 8 aa, Unknown
  Synthetic Peptide
LSHNSYEK

SEQ ID NO: 681 - protein, 10 aa, Unknown
  Synthetic Peptide
LSHNSYEKTK

SEQ ID NO: 682 - protein, 8 aa, Unknown
  Synthetic Peptide
NIFLKENK

SEQ ID NO: 683 - protein, 11 aa, Unknown
  Synthetic Peptide
NIFLKENKLNK

SEQ ID NO: 684 - protein, 11 aa, Unknown
  Synthetic Peptide
NLDDLDEGIEK

SEQ ID NO: 685 - protein, 11 aa, Unknown
  Synthetic Peptide
NLGVSENIFLK

SEQ ID NO: 686 - protein, 10 aa, Unknown
  Synthetic Peptide
NLLIFHINGK

SEQ ID NO: 687 - protein, 10 aa, Unknown
  Synthetic Peptide
NLRSGSSNSR

SEQ ID NO: 688 - protein, 9 aa, Unknown
  Synthetic Peptide
NSEKDEIIK

SEQ ID NO: 689 - protein, 10 aa, Unknown
  Synthetic Peptide
NSRNRINEEK

SEQ ID NO: 690 - protein, 10 aa, Unknown
  Synthetic Peptide
NVEGRRDIHK

SEQ ID NO: 691 - protein, 11 aa, Unknown
  Synthetic Peptide
NVKNVSQTNFK

SEQ ID NO: 692 - protein, 8 aa, Unknown
  Synthetic Peptide
NVSQTNFK

SEQ ID NO: 693 - protein, 11 aa, Unknown
  Synthetic Peptide
PAIELPSENER

SEQ ID NO: 694 - protein, 8 aa, Unknown
  Synthetic Peptide
QSDLEQDR

SEQ ID NO: 695 - protein, 11 aa, Unknown
  Synthetic Peptide
QSDLEQDRLAK

SEQ ID NO: 696 - protein, 8 aa, Unknown
  Synthetic Peptide
QSDLEQER

SEQ ID NO: 697 - protein, 11 aa, Unknown
  Synthetic Peptide
QSDLEQERLAK

SEQ ID NO: 698 - protein, 9 aa, Unknown
  Synthetic Peptide
QSDLEQERR

SEQ ID NO: 699 - protein, 11 aa, Unknown
  Synthetic Peptide
QSDLEQERRAK

SEQ ID NO: 700 - protein, 8 aa, Unknown
  Synthetic Peptide
QSDLERTK

SEQ ID NO: 701 - protein, 11 aa, Unknown
  Synthetic Peptide
QSDLERTKASK

SEQ ID NO: 702 - protein, 8 aa, Unknown
  Synthetic Peptide
QSDSEQER

SEQ ID NO: 703 - protein, 11 aa, Unknown
  Synthetic Peptide
QSDSEQERLAK

SEQ ID NO: 704 - protein, 9 aa, Unknown
  Synthetic Peptide
QSSLPQDNR

SEQ ID NO: 705 - protein, 9 aa, Unknown
  Synthetic Peptide
QTNFKSLLR

SEQ ID NO: 706 - protein, 8 aa, Unknown
  Synthetic Peptide
QVNKEKEK

SEQ ID NO: 707 - protein, 11 aa, Unknown
  Synthetic Peptide
QVNKEKEKFIK

SEQ ID NO: 708 - protein, 9 aa, Unknown
  Synthetic Peptide
RINEEKHEK

SEQ ID NO: 709 - protein, 10 aa, Unknown
  Synthetic Peptide
RINEEKHEKK

SEQ ID NO: 710 - protein, 8 aa, Unknown
  Synthetic Peptide
RSGSSNSR

SEQ ID NO: 711 - protein, 10 aa, Unknown
  Synthetic Peptide
RSGSSNSRNR

SEQ ID NO: 712 - protein, 8 aa, Unknown
  Synthetic Peptide
SIIEKTNR

SEQ ID NO: 713 - protein, 10 aa, Unknown
  Synthetic Peptide
SIKPEQKEDK

SEQ ID NO: 714 - protein, 9 aa, Unknown
  Synthetic Peptide
SITTNVEGR

SEQ ID NO: 715 - protein, 10 aa, Unknown
  Synthetic Peptide
SITTNVEGRR

SEQ ID NO: 716 - protein, 11 aa, Unknown
  Synthetic Peptide
SLPQDNRGNSR

SEQ ID NO: 717 - protein, 8 aa, Unknown
  Synthetic Peptide
SLYDEHIK

SEQ ID NO: 718 - protein, 9 aa, Unknown
  Synthetic Peptide
SLYDEHIKK

SEQ ID NO: 719 - protein, 11 aa, Unknown
  Synthetic Peptide
SLYDEHIKKYK

SEQ ID NO: 720 - protein, 9 aa, Unknown
  Synthetic Peptide
SSEELSEEK

SEQ ID NO: 721 - protein, 11 aa, Unknown
  Synthetic Peptide
SSEELSEEKIK

SEQ ID NO: 722 - protein, 8 aa, Unknown
  Synthetic Peptide
SSLPQDNR

SEQ ID NO: 723 - protein, 8 aa, Unknown
  Synthetic Peptide
TTNVEGRR

SEQ ID NO: 724 - protein, 9 aa, Unknown
  Synthetic Peptide
VLAEDLYGR

SEQ ID NO: 725 - protein, 9 aa, Unknown
  Synthetic Peptide
VLSHNSYEK

SEQ ID NO: 726 - protein, 11 aa, Unknown
  Synthetic Peptide
VLSHNSYEKTK

SEQ ID NO: 727 - protein, 8 aa, Unknown
  Synthetic Peptide
VSENIFLK

SEQ ID NO: 728 - protein, 11 aa, Unknown
  Synthetic Peptide
VSENIFLKENK

SEQ ID NO: 729 - protein, 11 aa, Unknown
  Synthetic Peptide
VSQTNFKSLLR

SEQ ID NO: 730 - protein, 9 aa, Unknown
  Synthetic Peptide
YIKGQDENR

SEQ ID NO: 731 - protein, 11 aa, Unknown
  Synthetic Peptide
ALLACAGLAYK

SEQ ID NO: 732 - protein, 8 aa, Unknown
  Synthetic Peptide
AVCVEVEK

SEQ ID NO: 733 - protein, 10 aa, Unknown
  Synthetic Peptide
CSVTCGKGTR

SEQ ID NO: 734 - protein, 8 aa, Unknown
  Synthetic Peptide
DALLQVRK

SEQ ID NO: 735 - protein, 8 aa, Unknown
  Synthetic Peptide
DASKNKEK

SEQ ID NO: 736 - protein, 9 aa, Unknown
  Synthetic Peptide
DIPKKPENK

SEQ ID NO: 737 - protein, 9 aa, Unknown
  Synthetic Peptide
DLDEPEQFR

SEQ ID NO: 738 - protein, 8 aa, Unknown
  Synthetic Peptide
DLFLVNGR

SEQ ID NO: 739 - protein, 8 aa, Unknown
  Synthetic Peptide
DSAWENVK

SEQ ID NO: 740 - protein, 8 aa, Unknown
  Synthetic Peptide
DSIQDSLK

SEQ ID NO: 741 - protein, 11 aa, Unknown
  Synthetic Peptide
DSIQDSLKESR

SEQ ID NO: 742 - protein, 8 aa, Unknown
  Synthetic Peptide
DSLKESRK

SEQ ID NO: 743 - protein, 10 aa, Unknown
  Synthetic Peptide
DVPKNPEDDR

SEQ ID NO: 744 - protein, 11 aa, Unknown
  Synthetic Peptide
DVQNNIVDEIK

SEQ ID NO: 745 - protein, 11 aa, Unknown
  Synthetic Peptide
EIIRLHSDASK

SEQ ID NO: 746 - protein, 10 aa, Unknown
  Synthetic Peptide
ELQEQCEEER

SEQ ID NO: 747 - protein, 8 aa, Unknown
  Synthetic Peptide
ETLGEEDK

SEQ ID NO: 748 - protein, 8 aa, Unknown
  Synthetic Peptide
EVPSDVPK

SEQ ID NO: 749 - protein, 11 aa, Unknown
  Synthetic Peptide
FLVGCHPSDGK

SEQ ID NO: 750 - protein, 11 aa, Unknown
  Synthetic Peptide
FMKAVCVEVEK

SEQ ID NO: 751 - protein, 8 aa, Unknown
  Synthetic Peptide
GINVAFNR

SEQ ID NO: 752 - protein, 11 aa, Unknown
  Synthetic Peptide
GIPDSIQDSLK

SEQ ID NO: 753 - protein, 8 aa, Unknown
  Synthetic Peptide
HAVPLAMK

SEQ ID NO: 754 - protein, 8 aa, Unknown
  Synthetic Peptide
HLNDRINR

SEQ ID NO: 755 - protein, 8 aa, Unknown
  Synthetic Peptide
HSDASKNK

SEQ ID NO: 756 - protein, 10 aa, Unknown
  Synthetic Peptide
HSDASKNKEK

SEQ ID NO: 757 - protein, 8 aa, Unknown
  Synthetic Peptide
HVPNSEDR

SEQ ID NO: 758 - protein, 11 aa, Unknown
  Synthetic Peptide
HVPNSEDRETR

SEQ ID NO: 759 - protein, 10 aa, Unknown
  Synthetic Peptide
IIRLHSDASK

SEQ ID NO: 760 - protein, 8 aa, Unknown
  Synthetic Peptide
IVDEIKYR

SEQ ID NO: 761 - protein, 9 aa, Unknown
  Synthetic Peptide
KAVCVEVEK

SEQ ID NO: 762 - protein, 8 aa, Unknown
  Synthetic Peptide
KVLDNERK

SEQ ID NO: 763 - protein, 9 aa, Unknown
  Synthetic Peptide
LACAGLAYK

SEQ ID NO: 764 - protein, 10 aa, Unknown
  Synthetic Peptide
LLACAGLAYK

SEQ ID NO: 765 - protein, 10 aa, Unknown
  Synthetic Peptide
LLMDCSGSIR

SEQ ID NO: 766 - protein, 11 aa, Unknown
  Synthetic Peptide
LLMDCSGSIRR

SEQ ID NO: 767 - protein, 11 aa, Unknown
  Synthetic Peptide
LLQVRKHLNDR

SEQ ID NO: 768 - protein, 10 aa, Unknown
  Synthetic Peptide
LLSTNLPYGR

SEQ ID NO: 769 - protein, 9 aa, Unknown
  Synthetic Peptide
LMDCSGSIR

SEQ ID NO: 770 - protein, 10 aa, Unknown
  Synthetic Peptide
LMDCSGSIRR

SEQ ID NO: 771 - protein, 9 aa, Unknown
  Synthetic Peptide
LSTNLPYGR

SEQ ID NO: 772 - protein, 10 aa, Unknown
  Synthetic Peptide
LVGCHPSDGK

SEQ ID NO: 773 - protein, 8 aa, Unknown
  Synthetic Peptide
NIPEDSEK

SEQ ID NO: 774 - protein, 9 aa, Unknown
  Synthetic Peptide
NIVDEIKYR

SEQ ID NO: 775 - protein, 9 aa, Unknown
  Synthetic Peptide
NLPNDKSDR

SEQ ID NO: 776 - protein, 8 aa, Unknown
  Synthetic Peptide
NSEDRETR

SEQ ID NO: 777 - protein, 8 aa, Unknown
  Synthetic Peptide
NVIGPFMK

SEQ ID NO: 778 - protein, 11 aa, Unknown
  Synthetic Peptide
NVKNVIGPFMK

SEQ ID NO: 779 - protein, 9 aa, Unknown
  Synthetic Peptide
PSPNPEEGK

SEQ ID NO: 780 - protein, 9 aa, Unknown
  Synthetic Peptide
QSQDNNGNR

SEQ ID NO: 781 - protein, 9 aa, Unknown
  Synthetic Peptide
QVRKHLNDR

SEQ ID NO: 782 - protein, 8 aa, Unknown
  Synthetic Peptide
RLHSDASK

SEQ ID NO: 783 - protein, 10 aa, Unknown
  Synthetic Peptide
RLHSDASKNK

SEQ ID NO: 784 - protein, 10 aa, Unknown
  Synthetic Peptide
SIQDSLKESR

SEQ ID NO: 785 - protein, 11 aa, Unknown
  Synthetic Peptide
SIQDSLKESRK

SEQ ID NO: 786 - protein, 11 aa, Unknown
  Synthetic Peptide
SLLSTNLPYGR

SEQ ID NO: 787 - protein, 8 aa, Unknown
  Synthetic Peptide
STNLPYGR

SEQ ID NO: 788 - protein, 9 aa, Unknown
  Synthetic Peptide
SVTCGKGTR

SEQ ID NO: 789 - protein, 11 aa, Unknown
  Synthetic Peptide
SVTCGKGTRSR

SEQ ID NO: 790 - protein, 8 aa, Unknown
  Synthetic Peptide
VTCGKGTR

SEQ ID NO: 791 - protein, 10 aa, Unknown
  Synthetic Peptide
VTCGKGTRSR

SEQ ID NO: 792 - protein, 11 aa, Unknown
  Synthetic Peptide
VTCGKGTRSRK

SEQ ID NO: 793 - protein, 10 aa, Unknown
  Synthetic Peptide
WSPCSVTCGK

SEQ ID NO: 794 - protein, 11 aa, Unknown
  Synthetic Peptide
WVNHAVPLAMK

SEQ ID NO: 795 - protein, 10 aa, Unknown
  Synthetic Peptide
YADSAWENVK

SEQ ID NO: 796 - protein, 11 aa, Unknown
  Synthetic Peptide
YLLMDCSGSIR

SEQ ID NO: 797 - protein, 8 aa, Unknown
  Synthetic Peptide
AILSVSSF

SEQ ID NO: 798 - protein, 9 aa, Unknown
  Synthetic Peptide
AILSVSSFL

SEQ ID NO: 799 - protein, 10 aa, Unknown
  Synthetic Peptide
AILSVSSFLF

SEQ ID NO: 800 - protein, 9 aa, Unknown
  Synthetic Peptide
ALFQEYQCY

SEQ ID NO: 801 - protein, 11 aa, Unknown
  Synthetic Peptide
CYGSSSNTRVL

SEQ ID NO: 802 - protein, 9 aa, Unknown
  Synthetic Peptide
DIEKKICKM

SEQ ID NO: 803 - protein, 10 aa, Unknown
  Synthetic Peptide
DYENDIEKKI

SEQ ID NO: 804 - protein, 9 aa, Unknown
  Synthetic Peptide
ELNYDNAGI

SEQ ID NO: 805 - protein, 11 aa, Unknown
  Synthetic Peptide
ELNYDNAGINL

SEQ ID NO: 806 - protein, 11 aa, Unknown
  Synthetic Peptide
EMNYYGKQENW

SEQ ID NO: 807 - protein, 8 aa, Unknown
  Synthetic Peptide
FLFVEALF

SEQ ID NO: 808 - protein, 11 aa, Unknown
  Synthetic Peptide
FLFVEALFQEY

SEQ ID NO: 809 - protein, 9 aa, Unknown
  Synthetic Peptide
FVEALFQEY

SEQ ID NO: 810 - protein, 8 aa, Unknown
  Synthetic Peptide
GINLYNEL

SEQ ID NO: 811 - protein, 10 aa, Unknown
  Synthetic Peptide
GINLYNELEM

SEQ ID NO: 812 - protein, 8 aa, Unknown
  Synthetic Peptide
GLIMVLSF

SEQ ID NO: 813 - protein, 9 aa, Unknown
  Synthetic Peptide
GLIMVLSFL

SEQ ID NO: 814 - protein, 10 aa, Unknown
  Synthetic Peptide
GLIMVLSFLF

SEQ ID NO: 815 - protein, 11 aa, Unknown
  Synthetic Peptide
GLIMVLSFLFL

SEQ ID NO: 816 - protein, 9 aa, Unknown
  Synthetic Peptide
HIEQYLKKI

SEQ ID NO: 817 - protein, 8 aa, Unknown
  Synthetic Peptide
ILSVSSFL

SEQ ID NO: 818 - protein, 9 aa, Unknown
  Synthetic Peptide
ILSVSSFLF

SEQ ID NO: 819 - protein, 8 aa, Unknown
  Synthetic Peptide
IMVLSFLF

SEQ ID NO: 820 - protein, 9 aa, Unknown
  Synthetic Peptide
IMVLSFLFL

SEQ ID NO: 821 - protein, 10 aa, Unknown
  Synthetic Peptide
KIQNSLSTEW

SEQ ID NO: 822 - protein, 10 aa, Unknown
  Synthetic Peptide
KLAILSVSSF

SEQ ID NO: 823 - protein, 11 aa, Unknown
  Synthetic Peptide
KLAILSVSSFL

SEQ ID NO: 824 - protein, 10 aa, Unknown
  Synthetic Peptide
KLRKPKHKKL

SEQ ID NO: 825 - protein, 9 aa, Unknown
  Synthetic Peptide
KMEKCSSVF

SEQ ID NO: 826 - protein, 8 aa, Unknown
  Synthetic Peptide
LFQEYQCY

SEQ ID NO: 827 - protein, 10 aa, Unknown
  Synthetic Peptide
LFVEALFQEY

SEQ ID NO: 828 - protein, 8 aa, Unknown
  Synthetic Peptide
LIMVLSFL

SEQ ID NO: 829 - protein, 9 aa, Unknown
  Synthetic Peptide
LIMVLSFLF

SEQ ID NO: 830 - protein, 10 aa, Unknown
  Synthetic Peptide
LIMVLSFLFL

SEQ ID NO: 831 - protein, 9 aa, Unknown
  Synthetic Peptide
LYNELEMNY

SEQ ID NO: 832 - protein, 10 aa, Unknown
  Synthetic Peptide
LYNELEMNYY

SEQ ID NO: 833 - protein, 8 aa, Unknown
  Synthetic Peptide
MMRKLAIL

SEQ ID NO: 834 - protein, 8 aa, Unknown
  Synthetic Peptide
MVLSFLFL

SEQ ID NO: 835 - protein, 8 aa, Unknown
  Synthetic Peptide
NLYNELEM

SEQ ID NO: 836 - protein, 10 aa, Unknown
  Synthetic Peptide
NLYNELEMNY

SEQ ID NO: 837 - protein, 11 aa, Unknown
  Synthetic Peptide
NLYNELEMNYY

SEQ ID NO: 838 - protein, 8 aa, Unknown
  Synthetic Peptide
NTRVLNEL

SEQ ID NO: 839 - protein, 10 aa, Unknown
  Synthetic Peptide
NTRVLNELNY

SEQ ID NO: 840 - protein, 9 aa, Unknown
  Synthetic Peptide
NVVNSSIGL

SEQ ID NO: 841 - protein, 10 aa, Unknown
  Synthetic Peptide
NVVNSSIGLI

SEQ ID NO: 842 - protein, 11 aa, Unknown
  Synthetic Peptide
NVVNSSIGLIM

SEQ ID NO: 843 - protein, 9 aa, Unknown
  Synthetic Peptide
NYDNAGINL

SEQ ID NO: 844 - protein, 10 aa, Unknown
  Synthetic Peptide
NYDNAGINLY

SEQ ID NO: 845 - protein, 9 aa, Unknown
  Synthetic Peptide
NYYGKQENW

SEQ ID NO: 846 - protein, 10 aa, Unknown
  Synthetic Peptide
NYYGKQENWY

SEQ ID NO: 847 - protein, 8 aa, Unknown
  Synthetic Peptide
RVLNELNY

SEQ ID NO: 848 - protein, 8 aa, Unknown
  Synthetic Peptide
SFLFVEAL

SEQ ID NO: 849 - protein, 9 aa, Unknown
  Synthetic Peptide
SFLFVEALF

SEQ ID NO: 850 - protein, 8 aa, Unknown
  Synthetic Peptide
SIGLIMVL

SEQ ID NO: 851 - protein, 10 aa, Unknown
  Synthetic Peptide
SIGLIMVLSF

SEQ ID NO: 852 - protein, 11 aa, Unknown
  Synthetic Peptide
SIGLIMVLSFL

SEQ ID NO: 853 - protein, 9 aa, Unknown
  Synthetic Peptide
SLKKNSRSL

SEQ ID NO: 854 - protein, 10 aa, Unknown
  Synthetic Peptide
SVFNVVNSSI

SEQ ID NO: 855 - protein, 11 aa, Unknown
  Synthetic Peptide
SVSSFLFVEAL

SEQ ID NO: 856 - protein, 8 aa, Unknown
  Synthetic Peptide
SVTCGNGI

SEQ ID NO: 857 - protein, 9 aa, Unknown
  Synthetic Peptide
VFNVVNSSI

SEQ ID NO: 858 - protein, 11 aa, Unknown
  Synthetic Peptide
VFNVVNSSIGL

SEQ ID NO: 859 - protein, 11 aa, Unknown
  Synthetic Peptide
VTCGNGIQVRI

SEQ ID NO: 860 - protein, 8 aa, Unknown
  Synthetic Peptide
VVNSSIGL

SEQ ID NO: 861 - protein, 9 aa, Unknown
  Synthetic Peptide
VVNSSIGLI

SEQ ID NO: 862 - protein, 10 aa, Unknown
  Synthetic Peptide
VVNSSIGLIM

SEQ ID NO: 863 - protein, 11 aa, Unknown
  Synthetic Peptide
WYSLKKNSRSL

SEQ ID NO: 864 - protein, 9 aa, Unknown
  Synthetic Peptide
YLKKIQNSL

SEQ ID NO: 865 - protein, 8 aa, Unknown
  Synthetic Peptide
YYGKQENW

SEQ ID NO: 866 - protein, 9 aa, Unknown
  Synthetic Peptide
YYGKQENWY

SEQ ID NO: 867 - protein, 11 aa, Unknown
  Synthetic Peptide
YYGKQENWYSL

SEQ ID NO: 868 - protein, 8 aa, Unknown
  Synthetic Peptide
ATSVLAGL

SEQ ID NO: 869 - protein, 9 aa, Unknown
  Synthetic Peptide
ATSVLAGLL

SEQ ID NO: 870 - protein, 9 aa, Unknown
  Synthetic Peptide
DMIKKEEEL

SEQ ID NO: 871 - protein, 9 aa, Unknown
  Synthetic Peptide
DVHDLISDM

SEQ ID NO: 872 - protein, 10 aa, Unknown
  Synthetic Peptide
DVHDLISDMI

SEQ ID NO: 873 - protein, 9 aa, Unknown
  Synthetic Peptide
EVNKRKSKY

SEQ ID NO: 874 - protein, 11 aa, Unknown
  Synthetic Peptide
EVNKRKSKYKL

SEQ ID NO: 875 - protein, 10 aa, Unknown
  Synthetic Peptide
FFIIFNKESL

SEQ ID NO: 876 - protein, 8 aa, Unknown
  Synthetic Peptide
FFLALFFI

SEQ ID NO: 877 - protein, 9 aa, Unknown
  Synthetic Peptide
FFLALFFII

SEQ ID NO: 878 - protein, 10 aa, Unknown
  Synthetic Peptide
FFLALFFIIF

SEQ ID NO: 879 - protein, 9 aa, Unknown
  Synthetic Peptide
FIIFNKESL

SEQ ID NO: 880 - protein, 8 aa, Unknown
  Synthetic Peptide
FLALFFII

SEQ ID NO: 881 - protein, 9 aa, Unknown
  Synthetic Peptide
FLALFFIIF

SEQ ID NO: 882 - protein, 10 aa, Unknown
  Synthetic Peptide
GLLGNVSTVL

SEQ ID NO: 883 - protein, 11 aa, Unknown
  Synthetic Peptide
GLLGNVSTVLL

SEQ ID NO: 884 - protein, 8 aa, Unknown
  Synthetic Peptide
IIFNKESL

SEQ ID NO: 885 - protein, 9 aa, Unknown
  Synthetic Peptide
ILSVFFLAL

SEQ ID NO: 886 - protein, 10 aa, Unknown
  Synthetic Peptide
ILSVFFLALF

SEQ ID NO: 887 - protein, 11 aa, Unknown
  Synthetic Peptide
ILSVFFLALFF

SEQ ID NO: 888 - protein, 8 aa, Unknown
  Synthetic Peptide
KILSVFFL

SEQ ID NO: 889 - protein, 10 aa, Unknown
  Synthetic Peptide
KILSVFFLAL

SEQ ID NO: 890 - protein, 11 aa, Unknown
  Synthetic Peptide
KILSVFFLALF

SEQ ID NO: 891 - protein, 10 aa, Unknown
  Synthetic Peptide
KLATSVLAGL

SEQ ID NO: 892 - protein, 11 aa, Unknown
  Synthetic Peptide
KLATSVLAGLL

SEQ ID NO: 893 - protein, 9 aa, Unknown
  Synthetic Peptide
KYKLATSVL

SEQ ID NO: 894 - protein, 11 aa, Unknown
  Synthetic Peptide
LFFIIFNKESL

SEQ ID NO: 895 - protein, 8 aa, Unknown
  Synthetic Peptide
LIDVHDLI

SEQ ID NO: 896 - protein, 11 aa, Unknown
  Synthetic Peptide
LIDVHDLISDM

SEQ ID NO: 897 - protein, 9 aa, Unknown
  Synthetic Peptide
LLGGVGLVL

SEQ ID NO: 898 - protein, 10 aa, Unknown
  Synthetic Peptide
LLGGVGLVLY

SEQ ID NO: 899 - protein, 9 aa, Unknown
  Synthetic Peptide
LLGNVSTVL

SEQ ID NO: 900 - protein, 10 aa, Unknown
  Synthetic Peptide
LLGNVSTVLL

SEQ ID NO: 901 - protein, 11 aa, Unknown
  Synthetic Peptide
LVEVNKRKSKY

SEQ ID NO: 902 - protein, 11 aa, Unknown
  Synthetic Peptide
LYNTEKGRHPF

SEQ ID NO: 903 - protein, 8 aa, Unknown
  Synthetic Peptide
MIKKEEEL

SEQ ID NO: 904 - protein, 9 aa, Unknown
  Synthetic Peptide
NTEKGRHPF

SEQ ID NO: 905 - protein, 11 aa, Unknown
  Synthetic Peptide
NTEKGRHPFKI

SEQ ID NO: 906 - protein, 8 aa, Unknown
  Synthetic Peptide
PLIDVHDL

SEQ ID NO: 907 - protein, 9 aa, Unknown
  Synthetic Peptide
PLIDVHDLI

SEQ ID NO: 908 - protein, 10 aa, Unknown
  Synthetic Peptide
STVLLGGVGL

SEQ ID NO: 909 - protein, 8 aa, Unknown
  Synthetic Peptide
SVFFLALF

SEQ ID NO: 910 - protein, 9 aa, Unknown
  Synthetic Peptide
SVFFLALFF

SEQ ID NO: 911 - protein, 10 aa, Unknown
  Synthetic Peptide
SVFFLALFFI

SEQ ID NO: 912 - protein, 11 aa, Unknown
  Synthetic Peptide
SVFFLALFFII

SEQ ID NO: 913 - protein, 9 aa, Unknown
  Synthetic Peptide
TVLLGGVGL

SEQ ID NO: 914 - protein, 11 aa, Unknown
  Synthetic Peptide
TVLLGGVGLVL

SEQ ID NO: 915 - protein, 8 aa, Unknown
  Synthetic Peptide
VFFLALFF

SEQ ID NO: 916 - protein, 9 aa, Unknown
  Synthetic Peptide
VFFLALFFI

SEQ ID NO: 917 - protein, 10 aa, Unknown
  Synthetic Peptide
VFFLALFFII

SEQ ID NO: 918 - protein, 11 aa, Unknown
  Synthetic Peptide
VFFLALFFIIF

SEQ ID NO: 919 - protein, 8 aa, Unknown
  Synthetic Peptide
VLLGGVGL

SEQ ID NO: 920 - protein, 10 aa, Unknown
  Synthetic Peptide
VLLGGVGLVL

SEQ ID NO: 921 - protein, 11 aa, Unknown
  Synthetic Peptide
VLLGGVGLVLY

SEQ ID NO: 922 - protein, 11 aa, Unknown
  Synthetic Peptide
DFQISKYEDEI

SEQ ID NO: 923 - protein, 9 aa, Unknown
  Synthetic Peptide
DITKYFMKL

SEQ ID NO: 924 - protein, 8 aa, Unknown
  Synthetic Peptide
DLDEFKPI

SEQ ID NO: 925 - protein, 11 aa, Unknown
  Synthetic Peptide
DLDEFKPIVQY

SEQ ID NO: 926 - protein, 11 aa, Unknown
  Synthetic Peptide
DLEEKAAKETL

SEQ ID NO: 927 - protein, 9 aa, Unknown
  Synthetic Peptide
DLIEKNENL

SEQ ID NO: 928 - protein, 8 aa, Unknown
  Synthetic Peptide
DLYGRLEI

SEQ ID NO: 929 - protein, 11 aa, Unknown
  Synthetic Peptide
DLYGRLEIPAI

SEQ ID NO: 930 - protein, 8 aa, Unknown
  Synthetic Peptide
DVLAEDLY

SEQ ID NO: 931 - protein, 11 aa, Unknown
  Synthetic Peptide
DVLAEDLYGRL

SEQ ID NO: 932 - protein, 10 aa, Unknown
  Synthetic Peptide
DVNDFQISKY

SEQ ID NO: 933 - protein, 8 aa, Unknown
  Synthetic Peptide
EFKPIVQY

SEQ ID NO: 934 - protein, 11 aa, Unknown
  Synthetic Peptide
EFKPIVQYDNF

SEQ ID NO: 935 - protein, 9 aa, Unknown
  Synthetic Peptide
EILQIVDEL

SEQ ID NO: 936 - protein, 10 aa, Unknown
  Synthetic Peptide
EISAEYDDSL

SEQ ID NO: 937 - protein, 11 aa, Unknown
  Synthetic Peptide
EISAEYDDSLI

SEQ ID NO: 938 - protein, 10 aa, Unknown
  Synthetic Peptide
ELPSENERGY

SEQ ID NO: 939 - protein, 11 aa, Unknown
  Synthetic Peptide
ELPSENERGYY

SEQ ID NO: 940 - protein, 9 aa, Unknown
  Synthetic Peptide
ELSEDITKY

SEQ ID NO: 941 - protein, 10 aa, Unknown
  Synthetic Peptide
ELSEDITKYF

SEQ ID NO: 942 - protein, 11 aa, Unknown
  Synthetic Peptide
ELSEDITKYFM

SEQ ID NO: 943 - protein, 10 aa, Unknown
  Synthetic Peptide
ETLQEQQSDL

SEQ ID NO: 944 - protein, 10 aa, Unknown
  Synthetic Peptide
ETLQGQQSDL

SEQ ID NO: 945 - protein, 11 aa, Unknown
  Synthetic Peptide
ETVNISDVNDF

SEQ ID NO: 946 - protein, 8 aa, Unknown
  Synthetic Peptide
FFDKDKEL

SEQ ID NO: 947 - protein, 10 aa, Unknown
  Synthetic Peptide
FFDKDKELTM

SEQ ID NO: 948 - protein, 8 aa, Unknown
  Synthetic Peptide
FIKSLFHI

SEQ ID NO: 949 - protein, 9 aa, Unknown
  Synthetic Peptide
FIKSLFHIF

SEQ ID NO: 950 - protein, 8 aa, Unknown
  Synthetic Peptide
FILVNLLI

SEQ ID NO: 951 - protein, 9 aa, Unknown
  Synthetic Peptide
FILVNLLIF

SEQ ID NO: 952 - protein, 11 aa, Unknown
  Synthetic Peptide
FILVNLLIFHI

SEQ ID NO: 953 - protein, 8 aa, Unknown
  Synthetic Peptide
FYFILVNL

SEQ ID NO: 954 - protein, 9 aa, Unknown
  Synthetic Peptide
FYFILVNLL

SEQ ID NO: 955 - protein, 10 aa, Unknown
  Synthetic Peptide
FYFILVNLLI

SEQ ID NO: 956 - protein, 11 aa, Unknown
  Synthetic Peptide
FYFILVNLLIF

SEQ ID NO: 957 - protein, 9 aa, Unknown
  Synthetic Peptide
GIEKSSEEL

SEQ ID NO: 958 - protein, 9 aa, Unknown
  Synthetic Peptide
GIYKELEDL

SEQ ID NO: 959 - protein, 10 aa, Unknown
  Synthetic Peptide
GIYKELEDLI

SEQ ID NO: 960 - protein, 8 aa, Unknown
  Synthetic Peptide
GVSENIFL

SEQ ID NO: 961 - protein, 10 aa, Unknown
  Synthetic Peptide
GYYIPHQSSL

SEQ ID NO: 962 - protein, 9 aa, Unknown
  Synthetic Peptide
HIFDGDNEI

SEQ ID NO: 963 - protein, 10 aa, Unknown
  Synthetic Peptide
HIFDGDNEIL

SEQ ID NO: 964 - protein, 8 aa, Unknown
  Synthetic Peptide
HILYISFY

SEQ ID NO: 965 - protein, 9 aa, Unknown
  Synthetic Peptide
HILYISFYF

SEQ ID NO: 966 - protein, 10 aa, Unknown
  Synthetic Peptide
HILYISFYFI

SEQ ID NO: 967 - protein, 11 aa, Unknown
  Synthetic Peptide
HILYISFYFIL

SEQ ID NO: 968 - protein, 10 aa, Unknown
  Synthetic Peptide
HLEEKKDGSI

SEQ ID NO: 969 - protein, 8 aa, Unknown
  Synthetic Peptide
HTLETVNI

SEQ ID NO: 970 - protein, 8 aa, Unknown
  Synthetic Peptide
HVLSHNSY

SEQ ID NO: 971 - protein, 8 aa, Unknown
  Synthetic Peptide
IFDGDNEI

SEQ ID NO: 972 - protein, 9 aa, Unknown
  Synthetic Peptide
IFDGDNEIL

SEQ ID NO: 973 - protein, 11 aa, Unknown
  Synthetic Peptide
IFDGDNEILQI

SEQ ID NO: 974 - protein, 8 aa, Unknown
  Synthetic Peptide
IFHINGKI

SEQ ID NO: 975 - protein, 9 aa, Unknown
  Synthetic Peptide
IFHINGKII

SEQ ID NO: 976 - protein, 8 aa, Unknown
  Synthetic Peptide
IFLKENKL

SEQ ID NO: 977 - protein, 10 aa, Unknown
  Synthetic Peptide
IIEKTNRESI

SEQ ID NO: 978 - protein, 10 aa, Unknown
  Synthetic Peptide
IIKNSEKDEI

SEQ ID NO: 979 - protein, 11 aa, Unknown
  Synthetic Peptide
IIKNSEKDEII

SEQ ID NO: 980 - protein, 11 aa, Unknown
  Synthetic Peptide
IINDDDDKKKY

SEQ ID NO: 981 - protein, 8 aa, Unknown
  Synthetic Peptide
ILQIVDEL

SEQ ID NO: 982 - protein, 8 aa, Unknown
  Synthetic Peptide
ILVNLLIF

SEQ ID NO: 983 - protein, 10 aa, Unknown
  Synthetic Peptide
ILVNLLIFHI

SEQ ID NO: 984 - protein, 8 aa, Unknown
  Synthetic Peptide
ILYISFYF

SEQ ID NO: 985 - protein, 9 aa, Unknown
  Synthetic Peptide
ILYISFYFI

SEQ ID NO: 986 - protein, 10 aa, Unknown
  Synthetic Peptide
ILYISFYFIL

SEQ ID NO: 987 - protein, 8 aa, Unknown
  Synthetic Peptide
ITKYFMKL

SEQ ID NO: 988 - protein, 11 aa, Unknown
  Synthetic Peptide
ITTNVEGRRDI

SEQ ID NO: 989 - protein, 9 aa, Unknown
  Synthetic Peptide
IVDELSEDI

SEQ ID NO: 990 - protein, 8 aa, Unknown
  Synthetic Peptide
IYKELEDL

SEQ ID NO: 991 - protein, 9 aa, Unknown
  Synthetic Peptide
IYKELEDLI

SEQ ID NO: 992 - protein, 9 aa, Unknown
  Synthetic Peptide
KFFDKDKEL

SEQ ID NO: 993 - protein, 11 aa, Unknown
  Synthetic Peptide
KFFDKDKELTM

SEQ ID NO: 994 - protein, 9 aa, Unknown
  Synthetic Peptide
KFIKSLFHI

SEQ ID NO: 995 - protein, 10 aa, Unknown
  Synthetic Peptide
KFIKSLFHIF

SEQ ID NO: 996 - protein, 11 aa, Unknown
  Synthetic Peptide
KIIKNSEKDEI

SEQ ID NO: 997 - protein, 8 aa, Unknown
  Synthetic Peptide
KIKKGKKY

SEQ ID NO: 998 - protein, 8 aa, Unknown
  Synthetic Peptide
KLNKEGKL

SEQ ID NO: 999 - protein, 9 aa, Unknown
  Synthetic Peptide
KLNKEGKLI

SEQ ID NO: 1000 - protein, 9 aa, Unknown
  Synthetic Peptide
KLQEQQRDL

SEQ ID NO: 1001 - protein, 9 aa, Unknown
  Synthetic Peptide
KLQEQQSDL

SEQ ID NO: 1002 - protein, 9 aa, Unknown
  Synthetic Peptide
KLQGQQSDL

SEQ ID NO: 1003 - protein, 10 aa, Unknown
  Synthetic Peptide
KTKNNENNKF

SEQ ID NO: 1004 - protein, 11 aa, Unknown
  Synthetic Peptide
KTKNNENNKFF

SEQ ID NO: 1005 - protein, 10 aa, Unknown
  Synthetic Peptide
KYEDEISAEY

SEQ ID NO: 1006 - protein, 10 aa, Unknown
  Synthetic Peptide
KYEKTKDNNF

SEQ ID NO: 1007 - protein, 11 aa, Unknown
  Synthetic Peptide
LFHIFDGDNEI

SEQ ID NO: 1008 - protein, 11 aa, Unknown
  Synthetic Peptide
LIDEEEDDEDL

SEQ ID NO: 1009 - protein, 8 aa, Unknown
  Synthetic Peptide
LIEKNENL

SEQ ID NO: 1010 - protein, 11 aa, Unknown
  Synthetic Peptide
LIEKNENLDDL

SEQ ID NO: 1011 - protein, 9 aa, Unknown
  Synthetic Peptide
LIFHINGKI

SEQ ID NO: 1012 - protein, 10 aa, Unknown
  Synthetic Peptide
LIFHINGKII

SEQ ID NO: 1013 - protein, 10 aa, Unknown
  Synthetic Peptide
LLIFHINGKI

SEQ ID NO: 1014 - protein, 11 aa, Unknown
  Synthetic Peptide
LLIFHINGKII

SEQ ID NO: 1015 - protein, 11 aa, Unknown
  Synthetic Peptide
LLRNLGVSENI

SEQ ID NO: 1016 - protein, 9 aa, Unknown
  Synthetic Peptide
LVNLLIFHI

SEQ ID NO: 1017 - protein, 9 aa, Unknown
  Synthetic Peptide
LYDEHIKKY

SEQ ID NO: 1018 - protein, 10 aa, Unknown
  Synthetic Peptide
LYGRLEIPAI

SEQ ID NO: 1019 - protein, 8 aa, Unknown
  Synthetic Peptide
LYISFYFI

SEQ ID NO: 1020 - protein, 9 aa, Unknown
  Synthetic Peptide
LYISFYFIL

SEQ ID NO: 1021 - protein, 9 aa, Unknown
  Synthetic Peptide
NFKPNDKSL

SEQ ID NO: 1022 - protein, 10 aa, Unknown
  Synthetic Peptide
NFKPNDKSLY

SEQ ID NO: 1023 - protein, 9 aa, Unknown
  Synthetic Peptide
NFKSLLRNL

SEQ ID NO: 1024 - protein, 8 aa, Unknown
  Synthetic Peptide
NFQDEENI

SEQ ID NO: 1025 - protein, 10 aa, Unknown
  Synthetic Peptide
NFQDEENIGI

SEQ ID NO: 1026 - protein, 11 aa, Unknown
  Synthetic Peptide
NFQDEENIGIY

SEQ ID NO: 1027 - protein, 9 aa, Unknown
  Synthetic Peptide
NIFLKENKL

SEQ ID NO: 1028 - protein, 8 aa, Unknown
  Synthetic Peptide
NIGIYKEL

SEQ ID NO: 1029 - protein, 11 aa, Unknown
  Synthetic Peptide
NIGIYKELEDL

SEQ ID NO: 1030 - protein, 8 aa, Unknown
  Synthetic Peptide
NISDVNDF

SEQ ID NO: 1031 - protein, 10 aa, Unknown
  Synthetic Peptide
NISDVNDFQI

SEQ ID NO: 1032 - protein, 9 aa, Unknown
  Synthetic Peptide
NLDDLDEGI

SEQ ID NO: 1033 - protein, 8 aa, Unknown
  Synthetic Peptide
NLGVSENI

SEQ ID NO: 1034 - protein, 9 aa, Unknown
  Synthetic Peptide
NLGVSENIF

SEQ ID NO: 1035 - protein, 10 aa, Unknown
  Synthetic Peptide
NLGVSENIFL

SEQ ID NO: 1036 - protein, 11 aa, Unknown
  Synthetic Peptide
NLLIFHINGKI

SEQ ID NO: 1037 - protein, 8 aa, Unknown
  Synthetic Peptide
NVEGRRDI

SEQ ID NO: 1038 - protein, 10 aa, Unknown
  Synthetic Peptide
NVKNVSQTNF

SEQ ID NO: 1039 - protein, 10 aa, Unknown
  Synthetic Peptide
NVSQTNFKSL

SEQ ID NO: 1040 - protein, 11 aa, Unknown
  Synthetic Peptide
NVSQTNFKSLL

SEQ ID NO: 1041 - protein, 8 aa, Unknown
  Synthetic Peptide
PIVQYDNF

SEQ ID NO: 1042 - protein, 9 aa, Unknown
  Synthetic Peptide
QISKYEDEI

SEQ ID NO: 1043 - protein, 10 aa, Unknown
  Synthetic Peptide
QIVDELSEDI

SEQ ID NO: 1044 - protein, 8 aa, Unknown
  Synthetic Peptide
QTNFKSLL

SEQ ID NO: 1045 - protein, 11 aa, Unknown
  Synthetic Peptide
QTNFKSLLRNL

SEQ ID NO: 1046 - protein, 9 aa, Unknown
  Synthetic Peptide
QVNKEKEKF

SEQ ID NO: 1047 - protein, 10 aa, Unknown
  Synthetic Peptide
QVNKEKEKFI

SEQ ID NO: 1048 - protein, 11 aa, Unknown
  Synthetic Peptide
QYDNFQDEENI

SEQ ID NO: 1049 - protein, 9 aa, Unknown
  Synthetic Peptide
RLEIPAIEL

SEQ ID NO: 1050 - protein, 9 aa, Unknown
  Synthetic Peptide
RTKASKETL

SEQ ID NO: 1051 - protein, 9 aa, Unknown
  Synthetic Peptide
SFYFILVNL

SEQ ID NO: 1052 - protein, 10 aa, Unknown
  Synthetic Peptide
SFYFILVNLL

SEQ ID NO: 1053 - protein, 11 aa, Unknown
  Synthetic Peptide
SFYFILVNLLI

SEQ ID NO: 1054 - protein, 11 aa, Unknown
  Synthetic Peptide
SIIEKTNRESI

SEQ ID NO: 1055 - protein, 10 aa, Unknown
  Synthetic Peptide
SLYDEHIKKY

SEQ ID NO: 1056 - protein, 9 aa, Unknown
  Synthetic Peptide
TLQEQQSDL

SEQ ID NO: 1057 - protein, 9 aa, Unknown
  Synthetic Peptide
TLQGQQSDL

SEQ ID NO: 1058 - protein, 10 aa, Unknown
  Synthetic Peptide
TTNVEGRRDI

SEQ ID NO: 1059 - protein, 10 aa, Unknown
  Synthetic Peptide
TVNISDVNDF

SEQ ID NO: 1060 - protein, 10 aa, Unknown
  Synthetic Peptide
VLAEDLYGRL

SEQ ID NO: 1061 - protein, 8 aa, Unknown
  Synthetic Peptide
YFILVNLL

SEQ ID NO: 1062 - protein, 9 aa, Unknown
  Synthetic Peptide
YFILVNLLI

SEQ ID NO: 1063 - protein, 10 aa, Unknown
  Synthetic Peptide
YFILVNLLIF

SEQ ID NO: 1064 - protein, 8 aa, Unknown
  Synthetic Peptide
YIPHQSSL

SEQ ID NO: 1065 - protein, 8 aa, Unknown
  Synthetic Peptide
YISFYFIL

SEQ ID NO: 1066 - protein, 11 aa, Unknown
  Synthetic Peptide
YISFYFILVNL

SEQ ID NO: 1067 - protein, 9 aa, Unknown
  Synthetic Peptide
YYIPHQSSL

SEQ ID NO: 1068 - protein, 8 aa, Unknown
  Synthetic Peptide
ALLACAGL

SEQ ID NO: 1069 - protein, 10 aa, Unknown
  Synthetic Peptide
ALLACAGLAY

SEQ ID NO: 1070 - protein, 9 aa, Unknown
  Synthetic Peptide
ALLQVRKHL

SEQ ID NO: 1071 - protein, 8 aa, Unknown
  Synthetic Peptide
AMKLIQQL

SEQ ID NO: 1072 - protein, 10 aa, Unknown
  Synthetic Peptide
AMKLIQQLNL

SEQ ID NO: 1073 - protein, 11 aa, Unknown
  Synthetic Peptide
ATPYAGEPAPF

SEQ ID NO: 1074 - protein, 9 aa, Unknown
  Synthetic Peptide
AVFGIGQGI

SEQ ID NO: 1075 - protein, 8 aa, Unknown
  Synthetic Peptide
AVPLAMKL

SEQ ID NO: 1076 - protein, 9 aa, Unknown
  Synthetic Peptide
AVPLAMKLI

SEQ ID NO: 1077 - protein, 9 aa, Unknown
  Synthetic Peptide
AWENVKNVI

SEQ ID NO: 1078 - protein, 8 aa, Unknown
  Synthetic Peptide
DLDEPEQF

SEQ ID NO: 1079 - protein, 10 aa, Unknown
  Synthetic Peptide
DLDEPEQFRL

SEQ ID NO: 1080 - protein, 10 aa, Unknown
  Synthetic Peptide
DVQNNIVDEI

SEQ ID NO: 1081 - protein, 11 aa, Unknown
  Synthetic Peptide
EILHEGCTSEL

SEQ ID NO: 1082 - protein, 10 aa, Unknown
  Synthetic Peptide
ETLGEEDKDL

SEQ ID NO: 1083 - protein, 9 aa, Unknown
  Synthetic Peptide
EVCNDEVDL

SEQ ID NO: 1084 - protein, 10 aa, Unknown
  Synthetic Peptide
EVCNDEVDLY

SEQ ID NO: 1085 - protein, 11 aa, Unknown
  Synthetic Peptide
EVCNDEVDLYL

SEQ ID NO: 1086 - protein, 8 aa, Unknown
  Synthetic Peptide
EVDLYLLM

SEQ ID NO: 1087 - protein, 11 aa, Unknown
  Synthetic Peptide
EVEKTASCGVW

SEQ ID NO: 1088 - protein, 8 aa, Unknown
  Synthetic Peptide
FLIFFDLF

SEQ ID NO: 1089 - protein, 9 aa, Unknown
  Synthetic Peptide
FLIFFDLFL

SEQ ID NO: 1090 - protein, 10 aa, Unknown
  Synthetic Peptide
FVVPGAATPY

SEQ ID NO: 1091 - protein, 8 aa, Unknown
  Synthetic Peptide
GIAGGLAL

SEQ ID NO: 1092 - protein, 9 aa, Unknown
  Synthetic Peptide
GIAGGLALL

SEQ ID NO: 1093 - protein, 10 aa, Unknown
  Synthetic Peptide
GIGQGINVAF

SEQ ID NO: 1094 - protein, 9 aa, Unknown
  Synthetic Peptide
GINVAFNRF

SEQ ID NO: 1095 - protein, 10 aa, Unknown
  Synthetic Peptide
GINVAFNRFL

SEQ ID NO: 1096 - protein, 10 aa, Unknown
  Synthetic Peptide
GIPDSIQDSL

SEQ ID NO: 1097 - protein, 10 aa, Unknown
  Synthetic Peptide
GLALLACAGL

SEQ ID NO: 1098 - protein, 9 aa, Unknown
  Synthetic Peptide
GTRSRKREI

SEQ ID NO: 1099 - protein, 10 aa, Unknown
  Synthetic Peptide
GTRSRKREIL

SEQ ID NO: 1100 - protein, 9 aa, Unknown
  Synthetic Peptide
GVKIAVFGI

SEQ ID NO: 1101 - protein, 8 aa, Unknown
  Synthetic Peptide
HLGNVKYL

SEQ ID NO: 1102 - protein, 10 aa, Unknown
  Synthetic Peptide
HLGNVKYLVI

SEQ ID NO: 1103 - protein, 10 aa, Unknown
  Synthetic Peptide
ILHEGCTSEL

SEQ ID NO: 1104 - protein, 10 aa, Unknown
  Synthetic Peptide
ILTDGIPDSI

SEQ ID NO: 1105 - protein, 9 aa, Unknown
  Synthetic Peptide
IVFLIFFDL

SEQ ID NO: 1106 - protein, 10 aa, Unknown
  Synthetic Peptide
IVFLIFFDLF

SEQ ID NO: 1107 - protein, 11 aa, Unknown
  Synthetic Peptide
IVFLIFFDLFL

SEQ ID NO: 1108 - protein, 11 aa, Unknown
  Synthetic Peptide
KFVVPGAATPY

SEQ ID NO: 1109 - protein, 10 aa, Unknown
  Synthetic Peptide
KIAGGIAGGL

SEQ ID NO: 1110 - protein, 11 aa, Unknown
  Synthetic Peptide
KIAVFGIGQGI

SEQ ID NO: 1111 - protein, 8 aa, Unknown
  Synthetic Peptide
KLIQQLNL

SEQ ID NO: 1112 - protein, 8 aa, Unknown
  Synthetic Peptide
KTASCGVW

SEQ ID NO: 1113 - protein, 11 aa, Unknown
  Synthetic Peptide
KTASCGVWDEW

SEQ ID NO: 1114 - protein, 8 aa, Unknown
  Synthetic Peptide
KYKIAGGI

SEQ ID NO: 1115 - protein, 8 aa, Unknown
  Synthetic Peptide
KYLVIVFL

SEQ ID NO: 1116 - protein, 9 aa, Unknown
  Synthetic Peptide
KYLVIVFLI

SEQ ID NO: 1117 - protein, 10 aa, Unknown
  Synthetic Peptide
KYLVIVFLIF

SEQ ID NO: 1118 - protein, 11 aa, Unknown
  Synthetic Peptide
KYLVIVFLIFF

SEQ ID NO: 1119 - protein, 8 aa, Unknown
  Synthetic Peptide
LIFFDLFL

SEQ ID NO: 1120 - protein, 9 aa, Unknown
  Synthetic Peptide
LLACAGLAY

SEQ ID NO: 1121 - protein, 11 aa, Unknown
  Synthetic Peptide
LLACAGLAYKF

SEQ ID NO: 1122 - protein, 9 aa, Unknown
  Synthetic Peptide
LLMDCSGSI

SEQ ID NO: 1123 - protein, 8 aa, Unknown
  Synthetic Peptide
LLQVRKHL

SEQ ID NO: 1124 - protein, 8 aa, Unknown
  Synthetic Peptide
LLSTNLPY

SEQ ID NO: 1125 - protein, 8 aa, Unknown
  Synthetic Peptide
LMDCSGSI

SEQ ID NO: 1126 - protein, 9 aa, Unknown
  Synthetic Peptide
LTDGIPDSI

SEQ ID NO: 1127 - protein, 8 aa, Unknown
  Synthetic Peptide
LVIVFLIF

SEQ ID NO: 1128 - protein, 9 aa, Unknown
  Synthetic Peptide
LVIVFLIFF

SEQ ID NO: 1129 - protein, 11 aa, Unknown
  Synthetic Peptide
LVIVFLIFFDL

SEQ ID NO: 1130 - protein, 11 aa, Unknown
  Synthetic Peptide
LVNGRDVQNNI

SEQ ID NO: 1131 - protein, 9 aa, Unknown
  Synthetic Peptide
LVVILTDGI

SEQ ID NO: 1132 - protein, 11 aa, Unknown
  Synthetic Peptide
LYLLMDCSGSI

SEQ ID NO: 1133 - protein, 8 aa, Unknown
  Synthetic Peptide
NIVDEIKY

SEQ ID NO: 1134 - protein, 9 aa, Unknown
  Synthetic Peptide
NLPYGRTNL

SEQ ID NO: 1135 - protein, 8 aa, Unknown
  Synthetic Peptide
NLYADSAW

SEQ ID NO: 1136 - protein, 8 aa, Unknown
  Synthetic Peptide
NVAFNRFL

SEQ ID NO: 1137 - protein, 9 aa, Unknown
  Synthetic Peptide
NVKNVIGPF

SEQ ID NO: 1138 - protein, 10 aa, Unknown
  Synthetic Peptide
NVKNVIGPFM

SEQ ID NO: 1139 - protein, 9 aa, Unknown
  Synthetic Peptide
NVKYLVIVF

SEQ ID NO: 1140 - protein, 10 aa, Unknown
  Synthetic Peptide
NVKYLVIVFL

SEQ ID NO: 1141 - protein, 11 aa, Unknown
  Synthetic Peptide
NVKYLVIVFLI

SEQ ID NO: 1142 - protein, 9 aa, Unknown
  Synthetic Peptide
NWVNHAVPL

SEQ ID NO: 1143 - protein, 11 aa, Unknown
  Synthetic Peptide
NWVNHAVPLAM

SEQ ID NO: 1144 - protein, 10 aa, Unknown
  Synthetic Peptide
PLAMKLIQQL

SEQ ID NO: 1145 - protein, 9 aa, Unknown
  Synthetic Peptide
PYAGEPAPF

SEQ ID NO: 1146 - protein, 10 aa, Unknown
  Synthetic Peptide
QFRLPEENEW

SEQ ID NO: 1147 - protein, 10 aa, Unknown
  Synthetic Peptide
QLVVILTDGI

SEQ ID NO: 1148 - protein, 10 aa, Unknown
  Synthetic Peptide
QVRKHLNDRI

SEQ ID NO: 1149 - protein, 10 aa, Unknown
  Synthetic Peptide
RINRENANQL

SEQ ID NO: 1150 - protein, 8 aa, Unknown
  Synthetic Peptide
RLPEENEW

SEQ ID NO: 1151 - protein, 8 aa, Unknown
  Synthetic Peptide
SLKESRKL

SEQ ID NO: 1152 - protein, 9 aa, Unknown
  Synthetic Peptide
SLLSTNLPY

SEQ ID NO: 1153 - protein, 11 aa, Unknown
  Synthetic Peptide
STNLPYGRTNL

SEQ ID NO: 1154 - protein, 9 aa, Unknown
  Synthetic Peptide
TLGEEDKDL

SEQ ID NO: 1155 - protein, 8 aa, Unknown
  Synthetic Peptide
VFGIGQGI

SEQ ID NO: 1156 - protein, 8 aa, Unknown
  Synthetic Peptide
VFLIFFDL

SEQ ID NO: 1157 - protein, 9 aa, Unknown
  Synthetic Peptide
VFLIFFDLF

SEQ ID NO: 1158 - protein, 10 aa, Unknown
  Synthetic Peptide
VFLIFFDLFL

SEQ ID NO: 1159 - protein, 11 aa, Unknown
  Synthetic Peptide
VILTDGIPDSI

SEQ ID NO: 1160 - protein, 8 aa, Unknown
  Synthetic Peptide
VIVFLIFF

SEQ ID NO: 1161 - protein, 10 aa, Unknown
  Synthetic Peptide
VIVFLIFFDL

SEQ ID NO: 1162 - protein, 11 aa, Unknown
  Synthetic Peptide
VIVFLIFFDLF

SEQ ID NO: 1163 - protein, 8 aa, Unknown
  Synthetic Peptide
VVILTDGI

SEQ ID NO: 1164 - protein, 9 aa, Unknown
  Synthetic Peptide
VVPGAATPY

SEQ ID NO: 1165 - protein, 8 aa, Unknown
  Synthetic Peptide
WVNHAVPL

SEQ ID NO: 1166 - protein, 10 aa, Unknown
  Synthetic Peptide
WVNHAVPLAM

SEQ ID NO: 1167 - protein, 10 aa, Unknown
  Synthetic Peptide
YLLMDCSGSI

SEQ ID NO: 1168 - protein, 8 aa, Unknown
  Synthetic Peptide
YLVIVFLI

SEQ ID NO: 1169 - protein, 9 aa, Unknown
  Synthetic Peptide
YLVIVFLIF

SEQ ID NO: 1170 - protein, 10 aa, Unknown
  Synthetic Peptide
YLVIVFLIFF

SEQ ID NO: 1171 - protein, 10 aa, Unknown
  Synthetic Peptide
EPSDKHIEQY

SEQ ID NO: 1172 - protein, 11 aa, Unknown
  Synthetic Peptide
EPSDKHIEQYL

SEQ ID NO: 1173 - protein, 8 aa, Unknown
  Synthetic Peptide
DPNANPNA

SEQ ID NO: 1174 - protein, 8 aa, Unknown
  Synthetic Peptide
DPNANPNV

SEQ ID NO: 1175 - protein, 10 aa, Unknown
  Synthetic Peptide
DPNRNVDENA

SEQ ID NO: 1176 - protein, 9 aa, Unknown
  Synthetic Peptide
MPNDPNRNV

SEQ ID NO: 1177 - protein, 10 aa, Unknown
  Synthetic Peptide
NPDPNANPNV

SEQ ID NO: 1178 - protein, 8 aa, Unknown
  Synthetic Peptide
NPNANPNA

SEQ ID NO: 1179 - protein, 8 aa, Unknown
  Synthetic Peptide
NPNVDPNA

SEQ ID NO: 1180 - protein, 11 aa, Unknown
  Synthetic Peptide
QPGDGNPDPNA

SEQ ID NO: 1181 - protein, 11 aa, Unknown
  Synthetic Peptide
SPCSVTCGNGI

SEQ ID NO: 1182 - protein, 10 aa, Unknown
  Synthetic Peptide
DPADNANPDA

SEQ ID NO: 1183 - protein, 9 aa, Unknown
  Synthetic Peptide
DPQVTAQDV

SEQ ID NO: 1184 - protein, 9 aa, Unknown
  Synthetic Peptide
EPLIDVHDL

SEQ ID NO: 1185 - protein, 10 aa, Unknown
  Synthetic Peptide
EPLIDVHDLI

SEQ ID NO: 1186 - protein, 8 aa, Unknown
  Synthetic Peptide
EPNADPQV

SEQ ID NO: 1187 - protein, 10 aa, Unknown
  Synthetic Peptide
EPNADPQVTA

SEQ ID NO: 1188 - protein, 11 aa, Unknown
  Synthetic Peptide
HPFKIGSSDPA

SEQ ID NO: 1189 - protein, 9 aa, Unknown
  Synthetic Peptide
QPQGDDNNL

SEQ ID NO: 1190 - protein, 10 aa, Unknown
  Synthetic Peptide
QPQGDDNNLV

SEQ ID NO: 1191 - protein, 10 aa, Unknown
  Synthetic Peptide
KPEQKEDKSA

SEQ ID NO: 1192 - protein, 9 aa, Unknown
  Synthetic Peptide
KPIVQYDNF

SEQ ID NO: 1193 - protein, 8 aa, Unknown
  Synthetic Peptide
KPNDKSLY

SEQ ID NO: 1194 - protein, 9 aa, Unknown
  Synthetic Peptide
LPSENERGY

SEQ ID NO: 1195 - protein, 10 aa, Unknown
  Synthetic Peptide
LPSENERGYY

SEQ ID NO: 1196 - protein, 11 aa, Unknown
  Synthetic Peptide
LPSENERGYYI

SEQ ID NO: 1197 - protein, 9 aa, Unknown
  Synthetic Peptide
EPAPFDETL

SEQ ID NO: 1198 - protein, 9 aa, Unknown
  Synthetic Peptide
GPFMKAVCV

SEQ ID NO: 1199 - protein, 11 aa, Unknown
  Synthetic Peptide
GPFMKAVCVEV

SEQ ID NO: 1200 - protein, 9 aa, Unknown
  Synthetic Peptide
HPSDGKCNL

SEQ ID NO: 1201 - protein, 10 aa, Unknown
  Synthetic Peptide
HPSDGKCNLY

SEQ ID NO: 1202 - protein, 11 aa, Unknown
  Synthetic Peptide
HPSDGKCNLYA

SEQ ID NO: 1203 - protein, 9 aa, Unknown
  Synthetic Peptide
IPDSIQDSL

SEQ ID NO: 1204 - protein, 9 aa, Unknown
  Synthetic Peptide
IPEDSEKEV

SEQ ID NO: 1205 - protein, 8 aa, Unknown
  Synthetic Peptide
LPYGRTNL

SEQ ID NO: 1206 - protein, 10 aa, Unknown
  Synthetic Peptide
NPEDDREENF

SEQ ID NO: 1207 - protein, 9 aa, Unknown
  Synthetic Peptide
QPRPRGDNF

SEQ ID NO: 1208 - protein, 10 aa, Unknown
  Synthetic Peptide
QPRPRGDNFA

SEQ ID NO: 1209 - protein, 11 aa, Unknown
  Synthetic Peptide
QPRPRGDNFAV

SEQ ID NO: 1210 - protein, 8 aa, Unknown
  Synthetic Peptide
RPRGDNFA

SEQ ID NO: 1211 - protein, 9 aa, Unknown
  Synthetic Peptide
RPRGDNFAV

SEQ ID NO: 1212 - protein, 8 aa, Unknown
  Synthetic Peptide
TPYAGEPA

SEQ ID NO: 1213 - protein, 10 aa, Unknown
  Synthetic Peptide
TPYAGEPAPF

SEQ ID NO: 1214 - protein, 8 aa, Unknown
  Synthetic Peptide
VPGAATPY

SEQ ID NO: 1215 - protein, 9 aa, Unknown
  Synthetic Peptide
VPGAATPYA

SEQ ID NO: 1216 - protein, 8 aa, Unknown
  Synthetic Peptide
VPLAMKLI

SEQ ID NO: 1217 - protein, 11 aa, Unknown
  Synthetic Peptide
VPLAMKLIQQL

SEQ ID NO: 1218 - protein, 10 aa, Unknown
  Synthetic Peptide
CKMEKCSSVF

SEQ ID NO: 1219 - protein, 8 aa, Unknown
  Synthetic Peptide
DKHIEQYL

SEQ ID NO: 1220 - protein, 11 aa, Unknown
  Synthetic Peptide
DKHIEQYLKKI

SEQ ID NO: 1221 - protein, 11 aa, Unknown
  Synthetic Peptide
EKLRKPKHKKL

SEQ ID NO: 1222 - protein, 9 aa, Unknown
  Synthetic Peptide
GKQENWYSL

SEQ ID NO: 1223 - protein, 10 aa, Unknown
  Synthetic Peptide
KHIEQYLKKI

SEQ ID NO: 1224 - protein, 11 aa, Unknown
  Synthetic Peptide
KKIQNSLSTEW

SEQ ID NO: 1225 - protein, 8 aa, Unknown
  Synthetic Peptide
LKKIQNSL

SEQ ID NO: 1226 - protein, 8 aa, Unknown
  Synthetic Peptide
LKKNSRSL

SEQ ID NO: 1227 - protein, 9 aa, Unknown
  Synthetic Peptide
LRKPKHKKL

SEQ ID NO: 1228 - protein, 11 aa, Unknown
  Synthetic Peptide
RKLAILSVSSF

SEQ ID NO: 1229 - protein, 8 aa, Unknown
  Synthetic Peptide
RKPKHKKL

SEQ ID NO: 1230 - protein, 9 aa, Unknown
  Synthetic Peptide
TRVLNELNY

SEQ ID NO: 1231 - protein, 9 aa, Unknown
  Synthetic Peptide
EKGRHPFKI

SEQ ID NO: 1232 - protein, 8 aa, Unknown
  Synthetic Peptide
KKGSGEPL

SEQ ID NO: 1233 - protein, 9 aa, Unknown
  Synthetic Peptide
KKGSGEPLI

SEQ ID NO: 1234 - protein, 11 aa, Unknown
  Synthetic Peptide
KKNKKGSGEPL

SEQ ID NO: 1235 - protein, 8 aa, Unknown
  Synthetic Peptide
KRKSKYKL

SEQ ID NO: 1236 - protein, 8 aa, Unknown
  Synthetic Peptide
MKILSVFF

SEQ ID NO: 1237 - protein, 9 aa, Unknown
  Synthetic Peptide
MKILSVFFL

SEQ ID NO: 1238 - protein, 11 aa, Unknown
  Synthetic Peptide
MKILSVFFLAL

SEQ ID NO: 1239 - protein, 9 aa, Unknown
  Synthetic Peptide
NKKGSGEPL

SEQ ID NO: 1240 - protein, 10 aa, Unknown
  Synthetic Peptide
NKKGSGEPLI

SEQ ID NO: 1241 - protein, 9 aa, Unknown
  Synthetic Peptide
NKRKSKYKL

SEQ ID NO: 1242 - protein, 10 aa, Unknown
  Synthetic Peptide
SKYKLATSVL

SEQ ID NO: 1243 - protein, 8 aa, Unknown
  Synthetic Peptide
VHDLISDM

SEQ ID NO: 1244 - protein, 9 aa, Unknown
  Synthetic Peptide
VHDLISDMI

SEQ ID NO: 1245 - protein, 8 aa, Unknown
  Synthetic Peptide
YKLATSVL

SEQ ID NO: 1246 - protein, 11 aa, Unknown
  Synthetic Peptide
YKLATSVLAGL

SEQ ID NO: 1247 - protein, 8 aa, Unknown
  Synthetic Peptide
DKDKELTM

SEQ ID NO: 1248 - protein, 11 aa, Unknown
  Synthetic Peptide
DKQVNKEKEKF

SEQ ID NO: 1249 - protein, 11 aa, Unknown
  Synthetic Peptide
DKSADIQNHTL

SEQ ID NO: 1250 - protein, 9 aa, Unknown
  Synthetic Peptide
DKSLYDEHI

SEQ ID NO: 1251 - protein, 8 aa, Unknown
  Synthetic Peptide
DRLAKEKL

SEQ ID NO: 1252 - protein, 10 aa, Unknown
  Synthetic Peptide
EHGDVLAEDL

SEQ ID NO: 1253 - protein, 11 aa, Unknown
  Synthetic Peptide
EHGDVLAEDLY

SEQ ID NO: 1254 - protein, 8 aa, Unknown
  Synthetic Peptide
EKAAKETL

SEQ ID NO: 1255 - protein, 10 aa, Unknown
  Synthetic Peptide
EKDEIIKSNL

SEQ ID NO: 1256 - protein, 9 aa, Unknown
  Synthetic Peptide
EKEKFIKSL

SEQ ID NO: 1257 - protein, 10 aa, Unknown
  Synthetic Peptide
EKEKFIKSLF

SEQ ID NO: 1258 - protein, 8 aa, Unknown
  Synthetic Peptide
EKFIKSLF

SEQ ID NO: 1259 - protein, 10 aa, Unknown
  Synthetic Peptide
EKFIKSLFHI

SEQ ID NO: 1260 - protein, 11 aa, Unknown
  Synthetic Peptide
EKFIKSLFHIF

SEQ ID NO: 1261 - protein, 9 aa, Unknown
  Synthetic Peptide
EKHEKKHVL

SEQ ID NO: 1262 - protein, 9 aa, Unknown
  Synthetic Peptide
EKIKKGKKY

SEQ ID NO: 1263 - protein, 11 aa, Unknown
  Synthetic Peptide
EKKHVLSHNSY

SEQ ID NO: 1264 - protein, 10 aa, Unknown
  Synthetic Peptide
EKLQEQQRDL

SEQ ID NO: 1265 - protein, 10 aa, Unknown
  Synthetic Peptide
EKLQEQQSDL

SEQ ID NO: 1266 - protein, 10 aa, Unknown
  Synthetic Peptide
EKLQGQQSDL

SEQ ID NO: 1267 - protein, 9 aa, Unknown
  Synthetic Peptide
EKNENLDDL

SEQ ID NO: 1268 - protein, 8 aa, Unknown
  Synthetic Peptide
EKTKDNNF

SEQ ID NO: 1269 - protein, 11 aa, Unknown
  Synthetic Peptide
EKTKNNENNKF

SEQ ID NO: 1270 - protein, 8 aa, Unknown
  Synthetic Peptide
EKTNRESI

SEQ ID NO: 1271 - protein, 10 aa, Unknown
  Synthetic Peptide
ERKKEHGDVL

SEQ ID NO: 1272 - protein, 8 aa, Unknown
  Synthetic Peptide
ERLAKEKL

SEQ ID NO: 1273 - protein, 8 aa, Unknown
  Synthetic Peptide
ERLANEKL

SEQ ID NO: 1274 - protein, 8 aa, Unknown
  Synthetic Peptide
ERRAKEKL

SEQ ID NO: 1275 - protein, 10 aa, Unknown
  Synthetic Peptide
ERTKASKETL

SEQ ID NO: 1276 - protein, 10 aa, Unknown
  Synthetic Peptide
FHIFDGDNEI

SEQ ID NO: 1277 - protein, 11 aa, Unknown
  Synthetic Peptide
FHIFDGDNEIL

SEQ ID NO: 1278 - protein, 8 aa, Unknown
  Synthetic Peptide
FHINGKII

SEQ ID NO: 1279 - protein, 10 aa, Unknown
  Synthetic Peptide
FKPIVQYDNF

SEQ ID NO: 1280 - protein, 8 aa, Unknown
  Synthetic Peptide
FKPNDKSL

SEQ ID NO: 1281 - protein, 9 aa, Unknown
  Synthetic Peptide
FKPNDKSLY

SEQ ID NO: 1282 - protein, 8 aa, Unknown
  Synthetic Peptide
FKSLLRNL

SEQ ID NO: 1283 - protein, 11 aa, Unknown
  Synthetic Peptide
GHLEEKKDGSI

SEQ ID NO: 1284 - protein, 8 aa, Unknown
  Synthetic Peptide
GKLIEHII

SEQ ID NO: 1285 - protein, 8 aa, Unknown
  Synthetic Peptide
GRLEIPAI

SEQ ID NO: 1286 - protein, 10 aa, Unknown
  Synthetic Peptide
GRLEIPAIEL

SEQ ID NO: 1287 - protein, 10 aa, Unknown
  Synthetic Peptide
GRRDIHKGHL

SEQ ID NO: 1288 - protein, 9 aa, Unknown
  Synthetic Peptide
IKNSEKDEI

SEQ ID NO: 1289 - protein, 10 aa, Unknown
  Synthetic Peptide
IKNSEKDEII

SEQ ID NO: 1290 - protein, 8 aa, Unknown
  Synthetic Peptide
IKSLFHIF

SEQ ID NO: 1291 - protein, 8 aa, Unknown
  Synthetic Peptide
KHEKKHVL

SEQ ID NO: 1292 - protein, 8 aa, Unknown
  Synthetic Peptide
KHILYISF

SEQ ID NO: 1293 - protein, 9 aa, Unknown
  Synthetic Peptide
KHILYISFY

SEQ ID NO: 1294 - protein, 10 aa, Unknown
  Synthetic Peptide
KHILYISFYF

SEQ ID NO: 1295 - protein, 11 aa, Unknown
  Synthetic Peptide
KHILYISFYFI

SEQ ID NO: 1296 - protein, 9 aa, Unknown
  Synthetic Peptide
KHVLSHNSY

SEQ ID NO: 1297 - protein, 8 aa, Unknown
  Synthetic Peptide
KKEHGDVL

SEQ ID NO: 1298 - protein, 10 aa, Unknown
  Synthetic Peptide
KKHVLSHNSY

SEQ ID NO: 1299 - protein, 11 aa, Unknown
  Synthetic Peptide
KKYEKTKDNNF

SEQ ID NO: 1300 - protein, 10 aa, Unknown
  Synthetic Peptide
LRNLGVSENI

SEQ ID NO: 1301 - protein, 11 aa, Unknown
  Synthetic Peptide
LRNLGVSENIF

SEQ ID NO: 1302 - protein, 9 aa, Unknown
  Synthetic Peptide
MKHILYISF

SEQ ID NO: 1303 - protein, 10 aa, Unknown
  Synthetic Peptide
MKHILYISFY

SEQ ID NO: 1304 - protein, 11 aa, Unknown
  Synthetic Peptide
MKHILYISFYF

SEQ ID NO: 1305 - protein, 9 aa, Unknown
  Synthetic Peptide
NHTLETVNI

SEQ ID NO: 1306 - protein, 10 aa, Unknown
  Synthetic Peptide
NKEGKLIEHI

SEQ ID NO: 1307 - protein, 11 aa, Unknown
  Synthetic Peptide
NKEGKLIEHII

SEQ ID NO: 1308 - protein, 8 aa, Unknown
  Synthetic Peptide
NKEKEKFI

SEQ ID NO: 1309 - protein, 11 aa, Unknown
  Synthetic Peptide
NKEKEKFIKSL

SEQ ID NO: 1310 - protein, 10 aa, Unknown
  Synthetic Peptide
NKFFDKDKEL

SEQ ID NO: 1311 - protein, 9 aa, Unknown
  Synthetic Peptide
NKLNKEGKL

SEQ ID NO: 1312 - protein, 10 aa, Unknown
  Synthetic Peptide
NKLNKEGKLI

SEQ ID NO: 1313 - protein, 11 aa, Unknown
  Synthetic Peptide
NRGNSRDSKEI

SEQ ID NO: 1314 - protein, 9 aa, Unknown
  Synthetic Peptide
QKEDKSADI

SEQ ID NO: 1315 - protein, 9 aa, Unknown
  Synthetic Peptide
QRDLEQERL

SEQ ID NO: 1316 - protein, 10 aa, Unknown
  Synthetic Peptide
QRKADTKKNL

SEQ ID NO: 1317 - protein, 9 aa, Unknown
  Synthetic Peptide
RKADTKKNL

SEQ ID NO: 1318 - protein, 9 aa, Unknown
  Synthetic Peptide
RKKEHGDVL

SEQ ID NO: 1319 - protein, 9 aa, Unknown
  Synthetic Peptide
RRDIHKGHL

SEQ ID NO: 1320 - protein, 11 aa, Unknown
  Synthetic Peptide
SKYEDEISAEY

SEQ ID NO: 1321 - protein, 9 aa, Unknown
  Synthetic Peptide
SRDSKEISI

SEQ ID NO: 1322 - protein, 10 aa, Unknown
  Synthetic Peptide
SRDSKEISII

SEQ ID NO: 1323 - protein, 8 aa, Unknown
  Synthetic Peptide
TKASKETL

SEQ ID NO: 1324 - protein, 9 aa, Unknown
  Synthetic Peptide
TKNNENNKF

SEQ ID NO: 1325 - protein, 10 aa, Unknown
  Synthetic Peptide
TKNNENNKFF

SEQ ID NO: 1326 - protein, 9 aa, Unknown
  Synthetic Peptide
VKNVSQTNF

SEQ ID NO: 1327 - protein, 8 aa, Unknown
  Synthetic Peptide
YKELEDLI

SEQ ID NO: 1328 - protein, 10 aa, Unknown
  Synthetic Peptide
CHPSDGKCNL

SEQ ID NO: 1329 - protein, 11 aa, Unknown
  Synthetic Peptide
CHPSDGKCNLY

SEQ ID NO: 1330 - protein, 10 aa, Unknown
  Synthetic Peptide
DKDLDEPEQF

SEQ ID NO: 1331 - protein, 8 aa, Unknown
  Synthetic Peptide
DREENFDI

SEQ ID NO: 1332 - protein, 9 aa, Unknown
  Synthetic Peptide
DRGVKIAVF

SEQ ID NO: 1333 - protein, 11 aa, Unknown
  Synthetic Peptide
DRGVKIAVFGI

SEQ ID NO: 1334 - protein, 11 aa, Unknown
  Synthetic Peptide
DRINRENANQL

SEQ ID NO: 1335 - protein, 9 aa, Unknown
  Synthetic Peptide
EKTASCGVW

SEQ ID NO: 1336 - protein, 9 aa, Unknown
  Synthetic Peptide
FRLPEENEW

SEQ ID NO: 1337 - protein, 11 aa, Unknown
  Synthetic Peptide
GKCNLYADSAW

SEQ ID NO: 1338 - protein, 11 aa, Unknown
  Synthetic Peptide
GKGTRSRKREI

SEQ ID NO: 1339 - protein, 8 aa, Unknown
  Synthetic Peptide
GRDVQNNI

SEQ ID NO: 1340 - protein, 9 aa, Unknown
  Synthetic Peptide
GRNNENRSY

SEQ ID NO: 1341 - protein, 8 aa, Unknown
  Synthetic Peptide
KHDNQNNL

SEQ ID NO: 1342 - protein, 9 aa, Unknown
  Synthetic Peptide
LHEGCTSEL

SEQ ID NO: 1343 - protein, 9 aa, Unknown
  Synthetic Peptide
MKLIQQLNL

SEQ ID NO: 1344 - protein, 8 aa, Unknown
  Synthetic Peptide
NHAVPLAM

SEQ ID NO: 1345 - protein, 10 aa, Unknown
  Synthetic Peptide
NHAVPLAMKL

SEQ ID NO: 1346 - protein, 11 aa, Unknown
  Synthetic Peptide
NHAVPLAMKLI

SEQ ID NO: 1347 - protein, 8 aa, Unknown
  Synthetic Peptide
NHLGNVKY

SEQ ID NO: 1348 - protein, 9 aa, Unknown
  Synthetic Peptide
NHLGNVKYL

SEQ ID NO: 1349 - protein, 11 aa, Unknown
  Synthetic Peptide
NHLGNVKYLVI

SEQ ID NO: 1350 - protein, 8 aa, Unknown
  Synthetic Peptide
NKEKALII

SEQ ID NO: 1351 - protein, 9 aa, Unknown
  Synthetic Peptide
NKEKALIII

SEQ ID NO: 1352 - protein, 9 aa, Unknown
  Synthetic Peptide
NKHDNQNNL

SEQ ID NO: 1353 - protein, 9 aa, Unknown
  Synthetic Peptide
NKYKIAGGI

SEQ ID NO: 1354 - protein, 8 aa, Unknown
  Synthetic Peptide
NRENANQL

SEQ ID NO: 1355 - protein, 11 aa, Unknown
  Synthetic Peptide
NRENANQLVVI

SEQ ID NO: 1356 - protein, 11 aa, Unknown
  Synthetic Peptide
PHGRNNENRSY

SEQ ID NO: 1357 - protein, 8 aa, Unknown
  Synthetic Peptide
PRPRGDNF

SEQ ID NO: 1358 - protein, 11 aa, Unknown
  Synthetic Peptide
RHNWVNHAVPL

SEQ ID NO: 1359 - protein, 8 aa, Unknown
  Synthetic Peptide
RKHLNDRI

SEQ ID NO: 1360 - protein, 8 aa, Unknown
  Synthetic Peptide
SKNKEKAL

SEQ ID NO: 1361 - protein, 9 aa, Unknown
  Synthetic Peptide
SKNKEKALI

SEQ ID NO: 1362 - protein, 10 aa, Unknown
  Synthetic Peptide
SKNKEKALII

SEQ ID NO: 1363 - protein, 11 aa, Unknown
  Synthetic Peptide
SKNKEKALIII

SEQ ID NO: 1364 - protein, 8 aa, Unknown
  Synthetic Peptide
TRSRKREI

SEQ ID NO: 1365 - protein, 9 aa, Unknown
  Synthetic Peptide
TRSRKREIL

SEQ ID NO: 1366 - protein, 8 aa, Unknown
  Synthetic Peptide
VKIAVFGI

SEQ ID NO: 1367 - protein, 8 aa, Unknown
  Synthetic Peptide
VKNVIGPF

SEQ ID NO: 1368 - protein, 9 aa, Unknown
  Synthetic Peptide
VKNVIGPFM

SEQ ID NO: 1369 - protein, 8 aa, Unknown
  Synthetic Peptide
VKYLVIVF

SEQ ID NO: 1370 - protein, 9 aa, Unknown
  Synthetic Peptide
VKYLVIVFL

SEQ ID NO: 1371 - protein, 10 aa, Unknown
  Synthetic Peptide
VKYLVIVFLI

SEQ ID NO: 1372 - protein, 11 aa, Unknown
  Synthetic Peptide
VKYLVIVFLIF

SEQ ID NO: 1373 - protein, 9 aa, Unknown
  Synthetic Peptide
VRKHLNDRI

SEQ ID NO: 1374 - protein, 11 aa, Unknown
  Synthetic Peptide
YKIAGGIAGGL

SEQ ID NO: 1375 - protein, 8 aa, Unknown
  Synthetic Peptide
CSSVFNVV

SEQ ID NO: 1376 - protein, 9 aa, Unknown
  Synthetic Peptide
CSVTCGNGI

SEQ ID NO: 1377 - protein, 11 aa, Unknown
  Synthetic Peptide
CSVTCGNGIQV

SEQ ID NO: 1378 - protein, 10 aa, Unknown
  Synthetic Peptide
EALFQEYQCY

SEQ ID NO: 1379 - protein, 8 aa, Unknown
  Synthetic Peptide
GSSSNTRV

SEQ ID NO: 1380 - protein, 9 aa, Unknown
  Synthetic Peptide
GSSSNTRVL

SEQ ID NO: 1381 - protein, 9 aa, Unknown
  Synthetic Peptide
LAILSVSSF

SEQ ID NO: 1382 - protein, 10 aa, Unknown
  Synthetic Peptide
LAILSVSSFL

SEQ ID NO: 1383 - protein, 11 aa, Unknown
  Synthetic Peptide
LAILSVSSFLF

SEQ ID NO: 1384 - protein, 10 aa, Unknown
  Synthetic Peptide
LSTEWSPCSV

SEQ ID NO: 1385 - protein, 8 aa, Unknown
  Synthetic Peptide
LSVSSFLF

SEQ ID NO: 1386 - protein, 9 aa, Unknown
  Synthetic Peptide
LSVSSFLFV

SEQ ID NO: 1387 - protein, 10 aa, Unknown
  Synthetic Peptide
NAGINLYNEL

SEQ ID NO: 1388 - protein, 8 aa, Unknown
  Synthetic Peptide
NANANNAV

SEQ ID NO: 1389 - protein, 8 aa, Unknown
  Synthetic Peptide
NSSIGLIM

SEQ ID NO: 1390 - protein, 9 aa, Unknown
  Synthetic Peptide
NSSIGLIMV

SEQ ID NO: 1391 - protein, 10 aa, Unknown
  Synthetic Peptide
NSSIGLIMVL

SEQ ID NO: 1392 - protein, 8 aa, Unknown
  Synthetic Peptide
NTRVLNEL

SEQ ID NO: 1393 - protein, 10 aa, Unknown
  Synthetic Peptide
NTRVLNELNY

SEQ ID NO: 1394 - protein, 9 aa, Unknown
  Synthetic Peptide
PSDKHIEQY

SEQ ID NO: 1395 - protein, 10 aa, Unknown
  Synthetic Peptide
PSDKHIEQYL

SEQ ID NO: 1396 - protein, 9 aa, Unknown
  Synthetic Peptide
SSFLFVEAL

SEQ ID NO: 1397 - protein, 10 aa, Unknown
  Synthetic Peptide
SSFLFVEALF

SEQ ID NO: 1398 - protein, 8 aa, Unknown
  Synthetic Peptide
SSIGLIMV

SEQ ID NO: 1399 - protein, 9 aa, Unknown
  Synthetic Peptide
SSIGLIMVL

SEQ ID NO: 1400 - protein, 11 aa, Unknown
  Synthetic Peptide
SSIGLIMVLSF

SEQ ID NO: 1401 - protein, 10 aa, Unknown
  Synthetic Peptide
SSNTRVLNEL

SEQ ID NO: 1402 - protein, 8 aa, Unknown
  Synthetic Peptide
SSSNTRVL

SEQ ID NO: 1403 - protein, 11 aa, Unknown
  Synthetic Peptide
SSSNTRVLNEL

SEQ ID NO: 1404 - protein, 11 aa, Unknown
  Synthetic Peptide
SSVFNVVNSSI

SEQ ID NO: 1405 - protein, 9 aa, Unknown
  Synthetic Peptide
STEWSPCSV

SEQ ID NO: 1406 - protein, 10 aa, Unknown
  Synthetic Peptide
VSSFLFVEAL

SEQ ID NO: 1407 - protein, 11 aa, Unknown
  Synthetic Peptide
VSSFLFVEALF

SEQ ID NO: 1408 - protein, 9 aa, Unknown
  Synthetic Peptide
VTCGNGIQV

SEQ ID NO: 1409 - protein, 11 aa, Unknown
  Synthetic Peptide
VTCGNGIQVRI

SEQ ID NO: 1410 - protein, 10 aa, Unknown
  Synthetic Peptide
YSLKKNSRSL

SEQ ID NO: 1411 - protein, 8 aa, Unknown
  Synthetic Peptide
ATSVLAGL

SEQ ID NO: 1412 - protein, 9 aa, Unknown
  Synthetic Peptide
ATSVLAGLL

SEQ ID NO: 1413 - protein, 9 aa, Unknown
  Synthetic Peptide
GSGEPLIDV

SEQ ID NO: 1414 - protein, 11 aa, Unknown
  Synthetic Peptide
ISDMIKKEEEL

SEQ ID NO: 1415 - protein, 10 aa, Unknown
  Synthetic Peptide
KSKYKLATSV

SEQ ID NO: 1416 - protein, 11 aa, Unknown
  Synthetic Peptide
KSKYKLATSVL

SEQ ID NO: 1417 - protein, 10 aa, Unknown
  Synthetic Peptide
KTNKGTGSGV

SEQ ID NO: 1418 - protein, 8 aa, Unknown
  Synthetic Peptide
LAGLLGNV

SEQ ID NO: 1419 - protein, 11 aa, Unknown
  Synthetic Peptide
LAGLLGNVSTV

SEQ ID NO: 1420 - protein, 8 aa, Unknown
  Synthetic Peptide
LALFFIIF

SEQ ID NO: 1421 - protein, 9 aa, Unknown
  Synthetic Peptide
LATSVLAGL

SEQ ID NO: 1422 - protein, 10 aa, Unknown
  Synthetic Peptide
LATSVLAGLL

SEQ ID NO: 1423 - protein, 8 aa, Unknown
  Synthetic Peptide
LSVFFLAL

SEQ ID NO: 1424 - protein, 9 aa, Unknown
  Synthetic Peptide
LSVFFLALF

SEQ ID NO: 1425 - protein, 10 aa, Unknown
  Synthetic Peptide
LSVFFLALFF

SEQ ID NO: 1426 - protein, 11 aa, Unknown
  Synthetic Peptide
LSVFFLALFFI

SEQ ID NO: 1427 - protein, 11 aa, Unknown
  Synthetic Peptide
NADPQVTAQDV

SEQ ID NO: 1428 - protein, 9 aa, Unknown
  Synthetic Peptide
NTEKGRHPF

SEQ ID NO: 1429 - protein, 11 aa, Unknown
  Synthetic Peptide
NTEKGRHPFKI

SEQ ID NO: 1430 - protein, 8 aa, Unknown
  Synthetic Peptide
STVLLGGV

SEQ ID NO: 1431 - protein, 10 aa, Unknown
  Synthetic Peptide
STVLLGGVGL

SEQ ID NO: 1432 - protein, 11 aa, Unknown
  Synthetic Peptide
STVLLGGVGLV

SEQ ID NO: 1433 - protein, 8 aa, Unknown
  Synthetic Peptide
TSVLAGLL

SEQ ID NO: 1434 - protein, 11 aa, Unknown
  Synthetic Peptide
TSVLAGLLGNV

SEQ ID NO: 1435 - protein, 9 aa, Unknown
  Synthetic Peptide
VSTVLLGGV

SEQ ID NO: 1436 - protein, 11 aa, Unknown
  Synthetic Peptide
VSTVLLGGVGL

SEQ ID NO: 1437 - protein, 8 aa, Unknown
  Synthetic Peptide
DSKEISII

SEQ ID NO: 1438 - protein, 10 aa, Unknown
  Synthetic Peptide
ETLQEQQSDL

SEQ ID NO: 1439 - protein, 10 aa, Unknown
  Synthetic Peptide
ETLQGQQSDL

SEQ ID NO: 1440 - protein, 8 aa, Unknown
  Synthetic Peptide
ETVNISDV

SEQ ID NO: 1441 - protein, 11 aa, Unknown
  Synthetic Peptide
ETVNISDVNDF

SEQ ID NO: 1442 - protein, 9 aa, Unknown
  Synthetic Peptide
GSSNSRNRI

SEQ ID NO: 1443 - protein, 8 aa, Unknown
  Synthetic Peptide
HTLETVNI

SEQ ID NO: 1444 - protein, 11 aa, Unknown
  Synthetic Peptide
HTLETVNISDV

SEQ ID NO: 1445 - protein, 9 aa, Unknown
  Synthetic Peptide
ISAEYDDSL

SEQ ID NO: 1446 - protein, 10 aa, Unknown
  Synthetic Peptide
ISAEYDDSLI

SEQ ID NO: 1447 - protein, 9 aa, Unknown
  Synthetic Peptide
ISDVNDFQI

SEQ ID NO: 1448 - protein, 8 aa, Unknown
  Synthetic Peptide
ISFYFILV

SEQ ID NO: 1449 - protein, 10 aa, Unknown
  Synthetic Peptide
ISFYFILVNL

SEQ ID NO: 1450 - protein, 11 aa, Unknown
  Synthetic Peptide
ISFYFILVNLL

SEQ ID NO: 1451 - protein, 8 aa, Unknown
  Synthetic Peptide
ISKYEDEI

SEQ ID NO: 1452 - protein, 8 aa, Unknown
  Synthetic Peptide
ITKYFMKL

SEQ ID NO: 1453 - protein, 11 aa, Unknown
  Synthetic Peptide
ITTNVEGRRDI

SEQ ID NO: 1454 - protein, 8 aa, Unknown
  Synthetic Peptide
KADTKKNL

SEQ ID NO: 1455 - protein, 10 aa, Unknown
  Synthetic Peptide
KSADIQNHTL

SEQ ID NO: 1456 - protein, 9 aa, Unknown
  Synthetic Peptide
KSLLRNLGV

SEQ ID NO: 1457 - protein, 8 aa, Unknown
  Synthetic Peptide
KSLYDEHI

SEQ ID NO: 1458 - protein, 11 aa, Unknown
  Synthetic Peptide
KSLYDEHIKKY

SEQ ID NO: 1459 - protein, 11 aa, Unknown
  Synthetic Peptide
KSSEELSEEKI

SEQ ID NO: 1460 - protein, 10 aa, Unknown
  Synthetic Peptide
KTKNNENNKF

SEQ ID NO: 1461 - protein, 11 aa, Unknown
  Synthetic Peptide
KTKNNENNKFF

SEQ ID NO: 1462 - protein, 11 aa, Unknown
  Synthetic Peptide
KTNRESITTNV

SEQ ID NO: 1463 - protein, 9 aa, Unknown
  Synthetic Peptide
LAEDLYGRL

SEQ ID NO: 1464 - protein, 11 aa, Unknown
  Synthetic Peptide
LAEDLYGRLEI

SEQ ID NO: 1465 - protein, 8 aa, Unknown
  Synthetic Peptide
LSEDITKY

SEQ ID NO: 1466 - protein, 9 aa, Unknown
  Synthetic Peptide
LSEDITKYF

SEQ ID NO: 1467 - protein, 10 aa, Unknown
  Synthetic Peptide
LSEDITKYFM

SEQ ID NO: 1468 - protein, 9 aa, Unknown
  Synthetic Peptide
LTMSNVKNV

SEQ ID NO: 1469 - protein, 8 aa, Unknown
  Synthetic Peptide
NSEKDEII

SEQ ID NO: 1470 - protein, 8 aa, Unknown
  Synthetic Peptide
NSRDSKEI

SEQ ID NO: 1471 - protein, 10 aa, Unknown
  Synthetic Peptide
NSRDSKEISI

SEQ ID NO: 1472 - protein, 11 aa, Unknown
  Synthetic Peptide
NSRDSKEISII

SEQ ID NO: 1473 - protein, 8 aa, Unknown
  Synthetic Peptide
PSENERGY

SEQ ID NO: 1474 - protein, 9 aa, Unknown
  Synthetic Peptide
PSENERGYY

SEQ ID NO: 1475 - protein, 10 aa, Unknown
  Synthetic Peptide
PSENERGYYI

SEQ ID NO: 1476 - protein, 9 aa, Unknown
  Synthetic Peptide
QSDLEQDRL

SEQ ID NO: 1477 - protein, 9 aa, Unknown
  Synthetic Peptide
QSDLEQERL

SEQ ID NO: 1478 - protein, 9 aa, Unknown
  Synthetic Peptide
QSDSEQERL

SEQ ID NO: 1479 - protein, 8 aa, Unknown
  Synthetic Peptide
QTNFKSLL

SEQ ID NO: 1480 - protein, 11 aa, Unknown
  Synthetic Peptide
QTNFKSLLRNL

SEQ ID NO: 1481 - protein, 11 aa, Unknown
  Synthetic Peptide
RSGSSNSRNRI

SEQ ID NO: 1482 - protein, 9 aa, Unknown
  Synthetic Peptide
RTKASKETL

SEQ ID NO: 1483 - protein, 9 aa, Unknown
  Synthetic Peptide
SADIQNHTL

SEQ ID NO: 1484 - protein, 8 aa, Unknown
  Synthetic Peptide
SAEYDDSL

SEQ ID NO: 1485 - protein, 9 aa, Unknown
  Synthetic Peptide
SAEYDDSLI

SEQ ID NO: 1486 - protein, 10 aa, Unknown
  Synthetic Peptide
SSEELSEEKI

SEQ ID NO: 1487 - protein, 8 aa, Unknown
  Synthetic Peptide
SSNSRNRI

SEQ ID NO: 1488 - protein, 10 aa, Unknown
  Synthetic Peptide
TTNVEGRRDI

SEQ ID NO: 1489 - protein, 9 aa, Unknown
  Synthetic Peptide
VSQTNFKSL

SEQ ID NO: 1490 - protein, 10 aa, Unknown
  Synthetic Peptide
VSQTNFKSLL

SEQ ID NO: 1491 - protein, 9 aa, Unknown
  Synthetic Peptide
ASCGVWDEW

SEQ ID NO: 1492 - protein, 9 aa, Unknown
  Synthetic Peptide
ASKNKEKAL

SEQ ID NO: 1493 - protein, 10 aa, Unknown
  Synthetic Peptide
ASKNKEKALI

SEQ ID NO: 1494 - protein, 11 aa, Unknown
  Synthetic Peptide
ASKNKEKALII

SEQ ID NO: 1495 - protein, 11 aa, Unknown
  Synthetic Peptide
ATPYAGEPAPF

SEQ ID NO: 1496 - protein, 8 aa, Unknown
  Synthetic Peptide
CAGLAYKF

SEQ ID NO: 1497 - protein, 9 aa, Unknown
  Synthetic Peptide
CAGLAYKFV

SEQ ID NO: 1498 - protein, 10 aa, Unknown
  Synthetic Peptide
CAGLAYKFVV

SEQ ID NO: 1499 - protein, 10 aa, Unknown
  Synthetic Peptide
CSGSIRRHNW

SEQ ID NO: 1500 - protein, 11 aa, Unknown
  Synthetic Peptide
CSGSIRRHNWV

SEQ ID NO: 1501 - protein, 10 aa, Unknown
  Synthetic Peptide
DALLQVRKHL

SEQ ID NO: 1502 - protein, 10 aa, Unknown
  Synthetic Peptide
DASKNKEKAL

SEQ ID NO: 1503 - protein, 11 aa, Unknown
  Synthetic Peptide
DASKNKEKALI

SEQ ID NO: 1504 - protein, 10 aa, Unknown
  Synthetic Peptide
DSAWENVKNV

SEQ ID NO: 1505 - protein, 11 aa, Unknown
  Synthetic Peptide
DSAWENVKNVI

SEQ ID NO: 1506 - protein, 10 aa, Unknown
  Synthetic Peptide
DSEKEVPSDV

SEQ ID NO: 1507 - protein, 9 aa, Unknown
  Synthetic Peptide
DSLKESRKL

SEQ ID NO: 1508 - protein, 10 aa, Unknown
  Synthetic Peptide
ETLGEEDKDL

SEQ ID NO: 1509 - protein, 8 aa, Unknown
  Synthetic Peptide
GSIRRHNW

SEQ ID NO: 1510 - protein, 9 aa, Unknown
  Synthetic Peptide
GSIRRHNWV

SEQ ID NO: 1511 - protein, 9 aa, Unknown
  Synthetic Peptide
GTRSRKREI

SEQ ID NO: 1512 - protein, 10 aa, Unknown
  Synthetic Peptide
GTRSRKREIL

SEQ ID NO: 1513 - protein, 9 aa, Unknown
  Synthetic Peptide
HAVPLAMKL

SEQ ID NO: 1514 - protein, 10 aa, Unknown
  Synthetic Peptide
HAVPLAMKLI

SEQ ID NO: 1515 - protein, 9 aa, Unknown
  Synthetic Peptide
IAGGIAGGL

SEQ ID NO: 1516 - protein, 11 aa, Unknown
  Synthetic Peptide
IAGGIAGGLAL

SEQ ID NO: 1517 - protein, 8 aa, Unknown
  Synthetic Peptide
IAGGLALL

SEQ ID NO: 1518 - protein, 10 aa, Unknown
  Synthetic Peptide
IAVFGIGQGI

SEQ ID NO: 1519 - protein, 8 aa, Unknown
  Synthetic Peptide
KTASCGVW

SEQ ID NO: 1520 - protein, 11 aa, Unknown
  Synthetic Peptide
KTASCGVWDEW

SEQ ID NO: 1521 - protein, 8 aa, Unknown
  Synthetic Peptide
LACAGLAY

SEQ ID NO: 1522 - protein, 10 aa, Unknown
  Synthetic Peptide
LACAGLAYKF

SEQ ID NO: 1523 - protein, 11 aa, Unknown
  Synthetic Peptide
LACAGLAYKFV

SEQ ID NO: 1524 - protein, 9 aa, Unknown
  Synthetic Peptide
LALLACAGL

SEQ ID NO: 1525 - protein, 11 aa, Unknown
  Synthetic Peptide
LALLACAGLAY

SEQ ID NO: 1526 - protein, 9 aa, Unknown
  Synthetic Peptide
LAMKLIQQL

SEQ ID NO: 1527 - protein, 11 aa, Unknown
  Synthetic Peptide
LAMKLIQQLNL

SEQ ID NO: 1528 - protein, 9 aa, Unknown
  Synthetic Peptide
LTDGIPDSI

SEQ ID NO: 1529 - protein, 8 aa, Unknown
  Synthetic Peptide
NANQLVVI

SEQ ID NO: 1530 - protein, 9 aa, Unknown
  Synthetic Peptide
NANQLVVIL

SEQ ID NO: 1531 - protein, 8 aa, Unknown
  Synthetic Peptide
PAPFDETL

SEQ ID NO: 1532 - protein, 8 aa, Unknown
  Synthetic Peptide
PSDGKCNL

SEQ ID NO: 1533 - protein, 9 aa, Unknown
  Synthetic Peptide
PSDGKCNLY

SEQ ID NO: 1534 - protein, 11 aa, Unknown
  Synthetic Peptide
QSQDNNGNRHV

SEQ ID NO: 1535 - protein, 8 aa, Unknown
  Synthetic Peptide
RSRKREIL

SEQ ID NO: 1536 - protein, 9 aa, Unknown
  Synthetic Peptide
SAWENVKNV

SEQ ID NO: 1537 - protein, 10 aa, Unknown
  Synthetic Peptide
SAWENVKNVI

SEQ ID NO: 1538 - protein, 11 aa, Unknown
  Synthetic Peptide
STNLPYGRTNL

SEQ ID NO: 1539 - protein, 10 aa, Unknown
  Synthetic Peptide
TASCGVWDEW

SEQ ID NO: 1540 - protein, 8 aa, Unknown
  Synthetic Peptide
VAFNRFLV

SEQ ID NO: 1541 - protein, 9 aa, Unknown
  Synthetic Peptide
YADSAWENV

SEQ ID NO: 1542 - protein, 8 aa, Unknown
  Synthetic Peptide
YAGEPAPF

SEQ ID NO: 1543 - protein, 8 aa, Unknown
  Synthetic Peptide
AILSVSSF

SEQ ID NO: 1544 - protein, 10 aa, Unknown
  Synthetic Peptide
AILSVSSFLF

SEQ ID NO: 1545 - protein, 11 aa, Unknown
  Synthetic Peptide
AILSVSSFLFV

SEQ ID NO: 1546 - protein, 9 aa, Unknown
  Synthetic Peptide
ALFQEYQCY

SEQ ID NO: 1547 - protein, 9 aa, Unknown
  Synthetic Peptide
DIEKKICKM

SEQ ID NO: 1548 - protein, 8 aa, Unknown
  Synthetic Peptide
DPNANPNV

SEQ ID NO: 1549 - protein, 9 aa, Unknown
  Synthetic Peptide
ELNYDNAGI

SEQ ID NO: 1550 - protein, 11 aa, Unknown
  Synthetic Peptide
EMNYYGKQENW

SEQ ID NO: 1551 - protein, 10 aa, Unknown
  Synthetic Peptide
EPSDKHIEQY

SEQ ID NO: 1552 - protein, 8 aa, Unknown
  Synthetic Peptide
FLFVEALF

SEQ ID NO: 1553 - protein, 11 aa, Unknown
  Synthetic Peptide
FLFVEALFQEY

SEQ ID NO: 1554 - protein, 9 aa, Unknown
  Synthetic Peptide
FVEALFQEY

SEQ ID NO: 1555 - protein, 10 aa, Unknown
  Synthetic Peptide
GINLYNELEM

SEQ ID NO: 1556 - protein, 8 aa, Unknown
  Synthetic Peptide
GLIMVLSF

SEQ ID NO: 1557 - protein, 10 aa, Unknown
  Synthetic Peptide
GLIMVLSFLF

SEQ ID NO: 1558 - protein, 9 aa, Unknown
  Synthetic Peptide
HIEQYLKKI

SEQ ID NO: 1559 - protein, 9 aa, Unknown
  Synthetic Peptide
ILSVSSFLF

SEQ ID NO: 1560 - protein, 10 aa, Unknown
  Synthetic Peptide
ILSVSSFLFV

SEQ ID NO: 1561 - protein, 8 aa, Unknown
  Synthetic Peptide
IMVLSFLF

SEQ ID NO: 1562 - protein, 9 aa, Unknown
  Synthetic Peptide
IQNSLSTEW

SEQ ID NO: 1563 - protein, 11 aa, Unknown
  Synthetic Peptide
KICKMEKCSSV

SEQ ID NO: 1564 - protein, 10 aa, Unknown
  Synthetic Peptide
KIQNSLSTEW

SEQ ID NO: 1565 - protein, 10 aa, Unknown
  Synthetic Peptide
KLAILSVSSF

SEQ ID NO: 1566 - protein, 8 aa, Unknown
  Synthetic Peptide
KMEKCSSV

SEQ ID NO: 1567 - protein, 9 aa, Unknown
  Synthetic Peptide
KMEKCSSVF

SEQ ID NO: 1568 - protein, 11 aa, Unknown
  Synthetic Peptide
KMEKCSSVFNV

SEQ ID NO: 1569 - protein, 9 aa, Unknown
  Synthetic Peptide
LIMVLSFLF

SEQ ID NO: 1570 - protein, 10 aa, Unknown
  Synthetic Peptide
MMRKLAILSV

SEQ ID NO: 1571 - protein, 9 aa, Unknown
  Synthetic Peptide
MPNDPNRNV

SEQ ID NO: 1572 - protein, 8 aa, Unknown
  Synthetic Peptide
NLYNELEM

SEQ ID NO: 1573 - protein, 10 aa, Unknown
  Synthetic Peptide
NLYNELEMNY

SEQ ID NO: 1574 - protein, 11 aa, Unknown
  Synthetic Peptide
NLYNELEMNYY

SEQ ID NO: 1575 - protein, 10 aa, Unknown
  Synthetic Peptide
NMPNDPNRNV

SEQ ID NO: 1576 - protein, 10 aa, Unknown
  Synthetic Peptide
NPDPNANPNV

SEQ ID NO: 1577 - protein, 10 aa, Unknown
  Synthetic Peptide
NQGNGQGHNM

SEQ ID NO: 1578 - protein, 10 aa, Unknown
  Synthetic Peptide
NVDPNANPNV

SEQ ID NO: 1579 - protein, 10 aa, Unknown
  Synthetic Peptide
NVVNSSIGLI

SEQ ID NO: 1580 - protein, 11 aa, Unknown
  Synthetic Peptide
NVVNSSIGLIM

SEQ ID NO: 1581 - protein, 8 aa, Unknown
  Synthetic Peptide
RVLNELNY

SEQ ID NO: 1582 - protein, 10 aa, Unknown
  Synthetic Peptide
SIGLIMVLSF

SEQ ID NO: 1583 - protein, 11 aa, Unknown
  Synthetic Peptide
SLSTEWSPCSV

SEQ ID NO: 1584 - protein, 11 aa, Unknown
  Synthetic Peptide
SPCSVTCGNGI

SEQ ID NO: 1585 - protein, 10 aa, Unknown
  Synthetic Peptide
SVFNVVNSSI

SEQ ID NO: 1586 - protein, 8 aa, Unknown
  Synthetic Peptide
SVSSFLFV

SEQ ID NO: 1587 - protein, 8 aa, Unknown
  Synthetic Peptide
SVTCGNGI

SEQ ID NO: 1588 - protein, 10 aa, Unknown
  Synthetic Peptide
SVTCGNGIQV

SEQ ID NO: 1589 - protein, 9 aa, Unknown
  Synthetic Peptide
VVNSSIGLI

SEQ ID NO: 1590 - protein, 10 aa, Unknown
  Synthetic Peptide
VVNSSIGLIM

SEQ ID NO: 1591 - protein, 11 aa, Unknown
  Synthetic Peptide
VVNSSIGLIMV

SEQ ID NO: 1592 - protein, 10 aa, Unknown
  Synthetic Peptide
DMIKKEEELV

SEQ ID NO: 1593 - protein, 9 aa, Unknown
  Synthetic Peptide
DPQVTAQDV

SEQ ID NO: 1594 - protein, 9 aa, Unknown
  Synthetic Peptide
DVHDLISDM

SEQ ID NO: 1595 - protein, 10 aa, Unknown
  Synthetic Peptide
DVHDLISDMI

SEQ ID NO: 1596 - protein, 10 aa, Unknown
  Synthetic Peptide
EPLIDVHDLI

SEQ ID NO: 1597 - protein, 8 aa, Unknown
  Synthetic Peptide
EPNADPQV

SEQ ID NO: 1598 - protein, 11 aa, Unknown
  Synthetic Peptide
EQPQGDDNNLV

SEQ ID NO: 1599 - protein, 9 aa, Unknown
  Synthetic Peptide
EVNKRKSKY

SEQ ID NO: 1600 - protein, 8 aa, Unknown
  Synthetic Peptide
FLALFFII

SEQ ID NO: 1601 - protein, 9 aa, Unknown
  Synthetic Peptide
FLALFFIIF

SEQ ID NO: 1602 - protein, 9 aa, Unknown
  Synthetic Peptide
GLLGNVSTV

SEQ ID NO: 1603 - protein, 10 aa, Unknown
  Synthetic Peptide
ILSVFFLALF

SEQ ID NO: 1604 - protein, 11 aa, Unknown
  Synthetic Peptide
ILSVFFLALFF

SEQ ID NO: 1605 - protein, 11 aa, Unknown
  Synthetic Peptide
KILSVFFLALF

SEQ ID NO: 1606 - protein, 8 aa, Unknown
  Synthetic Peptide
LIDVHDLI

SEQ ID NO: 1607 - protein, 11 aa, Unknown
  Synthetic Peptide
LIDVHDLISDM

SEQ ID NO: 1608 - protein, 8 aa, Unknown
  Synthetic Peptide
LLGGVGLV

SEQ ID NO: 1609 - protein, 10 aa, Unknown
  Synthetic Peptide
LLGGVGLVLY

SEQ ID NO: 1610 - protein, 8 aa, Unknown
  Synthetic Peptide
LLGNVSTV

SEQ ID NO: 1611 - protein, 11 aa, Unknown
  Synthetic Peptide
LVEVNKRKSKY

SEQ ID NO: 1612 - protein, 9 aa, Unknown
  Synthetic Peptide
MIKKEEELV

SEQ ID NO: 1613 - protein, 11 aa, Unknown
  Synthetic Peptide
MIKKEEELVEV

SEQ ID NO: 1614 - protein, 10 aa, Unknown
  Synthetic Peptide
NVSTVLLGGV

SEQ ID NO: 1615 - protein, 9 aa, Unknown
  Synthetic Peptide
PLIDVHDLI

SEQ ID NO: 1616 - protein, 9 aa, Unknown
  Synthetic Peptide
PQGDDNNLV

SEQ ID NO: 1617 - protein, 8 aa, Unknown
  Synthetic Peptide
PQVTAQDV

SEQ ID NO: 1618 - protein, 10 aa, Unknown
  Synthetic Peptide
QPQGDDNNLV

SEQ ID NO: 1619 - protein, 8 aa, Unknown
  Synthetic Peptide
SVFFLALF

SEQ ID NO: 1620 - protein, 9 aa, Unknown
  Synthetic Peptide
SVFFLALFF

SEQ ID NO: 1621 - protein, 10 aa, Unknown
  Synthetic Peptide
SVFFLALFFI

SEQ ID NO: 1622 - protein, 11 aa, Unknown
  Synthetic Peptide
SVFFLALFFII

SEQ ID NO: 1623 - protein, 10 aa, Unknown
  Synthetic Peptide
SVLAGLLGNV

SEQ ID NO: 1624 - protein, 10 aa, Unknown
  Synthetic Peptide
TVLLGGVGLV

SEQ ID NO: 1625 - protein, 9 aa, Unknown
  Synthetic Peptide
VLAGLLGNV

SEQ ID NO: 1626 - protein, 9 aa, Unknown
  Synthetic Peptide
VLLGGVGLV

SEQ ID NO: 1627 - protein, 11 aa, Unknown
  Synthetic Peptide
VLLGGVGLVLY

SEQ ID NO: 1628 - protein, 10 aa, Unknown
  Synthetic Peptide
DIQNHTLETV

SEQ ID NO: 1629 - protein, 8 aa, Unknown
  Synthetic Peptide
DLDEFKPI

SEQ ID NO: 1630 - protein, 9 aa, Unknown
  Synthetic Peptide
DLDEFKPIV

SEQ ID NO: 1631 - protein, 11 aa, Unknown
  Synthetic Peptide
DLDEFKPIVQY

SEQ ID NO: 1632 - protein, 8 aa, Unknown
  Synthetic Peptide
DLYGRLEI

SEQ ID NO: 1633 - protein, 11 aa, Unknown
  Synthetic Peptide
DLYGRLEIPAI

SEQ ID NO: 1634 - protein, 8 aa, Unknown
  Synthetic Peptide
DVLAEDLY

SEQ ID NO: 1635 - protein, 10 aa, Unknown
  Synthetic Peptide
DVNDFQISKY

SEQ ID NO: 1636 - protein, 11 aa, Unknown
  Synthetic Peptide
EISAEYDDSLI

SEQ ID NO: 1637 - protein, 10 aa, Unknown
  Synthetic Peptide
ELPSENERGY

SEQ ID NO: 1638 - protein, 11 aa, Unknown
  Synthetic Peptide
ELPSENERGYY

SEQ ID NO: 1639 - protein, 9 aa, Unknown
  Synthetic Peptide
ELSEDITKY

SEQ ID NO: 1640 - protein, 10 aa, Unknown
  Synthetic Peptide
ELSEDITKYF

SEQ ID NO: 1641 - protein, 11 aa, Unknown
  Synthetic Peptide
ELSEDITKYFM

SEQ ID NO: 1642 - protein, 10 aa, Unknown
  Synthetic Peptide
ELTMSNVKNV

SEQ ID NO: 1643 - protein, 10 aa, Unknown
  Synthetic Peptide
EQKEDKSADI

SEQ ID NO: 1644 - protein, 8 aa, Unknown
  Synthetic Peptide
FIKSLFHI

SEQ ID NO: 1645 - protein, 9 aa, Unknown
  Synthetic Peptide
FIKSLFHIF

SEQ ID NO: 1646 - protein, 8 aa, Unknown
  Synthetic Peptide
FILVNLLI

SEQ ID NO: 1647 - protein, 9 aa, Unknown
  Synthetic Peptide
FILVNLLIF

SEQ ID NO: 1648 - protein, 11 aa, Unknown
  Synthetic Peptide
FILVNLLIFHI

SEQ ID NO: 1649 - protein, 9 aa, Unknown
  Synthetic Peptide
FQDEENIGI

SEQ ID NO: 1650 - protein, 10 aa, Unknown
  Synthetic Peptide
FQDEENIGIY

SEQ ID NO: 1651 - protein, 10 aa, Unknown
  Synthetic Peptide
FQISKYEDEI

SEQ ID NO: 1652 - protein, 10 aa, Unknown
  Synthetic Peptide
GIYKELEDLI

SEQ ID NO: 1653 - protein, 9 aa, Unknown
  Synthetic Peptide
HIFDGDNEI

SEQ ID NO: 1654 - protein, 11 aa, Unknown
  Synthetic Peptide
HIKKYKNDKQV

SEQ ID NO: 1655 - protein, 8 aa, Unknown
  Synthetic Peptide
HILYISFY

SEQ ID NO: 1656 - protein, 9 aa, Unknown
  Synthetic Peptide
HILYISFYF

SEQ ID NO: 1657 - protein, 10 aa, Unknown
  Synthetic Peptide
HILYISFYFI

SEQ ID NO: 1658 - protein, 10 aa, Unknown
  Synthetic Peptide
HLEEKKDGSI

SEQ ID NO: 1659 - protein, 8 aa, Unknown
  Synthetic Peptide
HVLSHNSY

SEQ ID NO: 1660 - protein, 10 aa, Unknown
  Synthetic Peptide
IIEKTNRESI

SEQ ID NO: 1661 - protein, 10 aa, Unknown
  Synthetic Peptide
IIKNSEKDEI

SEQ ID NO: 1662 - protein, 11 aa, Unknown
  Synthetic Peptide
IIKNSEKDEII

SEQ ID NO: 1663 - protein, 11 aa, Unknown
  Synthetic Peptide
IINDDDDKKKY

SEQ ID NO: 1664 - protein, 8 aa, Unknown
  Synthetic Peptide
ILVNLLIF

SEQ ID NO: 1665 - protein, 10 aa, Unknown
  Synthetic Peptide
ILVNLLIFHI

SEQ ID NO: 1666 - protein, 8 aa, Unknown
  Synthetic Peptide
ILYISFYF

SEQ ID NO: 1667 - protein, 9 aa, Unknown
  Synthetic Peptide
ILYISFYFI

SEQ ID NO: 1668 - protein, 11 aa, Unknown
  Synthetic Peptide
ILYISFYFILV

SEQ ID NO: 1669 - protein, 9 aa, Unknown
  Synthetic Peptide
IQNHTLETV

SEQ ID NO: 1670 - protein, 11 aa, Unknown
  Synthetic Peptide
IQNHTLETVNI

SEQ ID NO: 1671 - protein, 9 aa, Unknown
  Synthetic Peptide
IVDELSEDI

SEQ ID NO: 1672 - protein, 11 aa, Unknown
  Synthetic Peptide
KIIKNSEKDEI

SEQ ID NO: 1673 - protein, 8 aa, Unknown
  Synthetic Peptide
KIKKGKKY

SEQ ID NO: 1674 - protein, 9 aa, Unknown
  Synthetic Peptide
KLNKEGKLI

SEQ ID NO: 1675 - protein, 9 aa, Unknown
  Synthetic Peptide
KPIVQYDNF

SEQ ID NO: 1676 - protein, 8 aa, Unknown
  Synthetic Peptide
KPNDKSLY

SEQ ID NO: 1677 - protein, 10 aa, Unknown
  Synthetic Peptide
KQVNKEKEKF

SEQ ID NO: 1678 - protein, 11 aa, Unknown
  Synthetic Peptide
KQVNKEKEKFI

SEQ ID NO: 1679 - protein, 9 aa, Unknown
  Synthetic Peptide
LIFHINGKI

SEQ ID NO: 1680 - protein, 10 aa, Unknown
  Synthetic Peptide
LIFHINGKII

SEQ ID NO: 1681 - protein, 10 aa, Unknown
  Synthetic Peptide
LLIFHINGKI

SEQ ID NO: 1682 - protein, 11 aa, Unknown
  Synthetic Peptide
LLIFHINGKII

SEQ ID NO: 1683 - protein, 11 aa, Unknown
  Synthetic Peptide
LLRNLGVSENI

SEQ ID NO: 1684 - protein, 9 aa, Unknown
  Synthetic Peptide
LPSENERGY

SEQ ID NO: 1685 - protein, 10 aa, Unknown
  Synthetic Peptide
LPSENERGYY

SEQ ID NO: 1686 - protein, 11 aa, Unknown
  Synthetic Peptide
LPSENERGYYI

SEQ ID NO: 1687 - protein, 11 aa, Unknown
  Synthetic Peptide
LQIVDELSEDI

SEQ ID NO: 1688 - protein, 9 aa, Unknown
  Synthetic Peptide
LVNLLIFHI

SEQ ID NO: 1689 - protein, 8 aa, Unknown
  Synthetic Peptide
NISDVNDF

SEQ ID NO: 1690 - protein, 10 aa, Unknown
  Synthetic Peptide
NISDVNDFQI

SEQ ID NO: 1691 - protein, 9 aa, Unknown
  Synthetic Peptide
NLDDLDEGI

SEQ ID NO: 1692 - protein, 11 aa, Unknown
  Synthetic Peptide
NLERKKEHGDV

SEQ ID NO: 1693 - protein, 8 aa, Unknown
  Synthetic Peptide
NLGVSENI

SEQ ID NO: 1694 - protein, 9 aa, Unknown
  Synthetic Peptide
NLGVSENIF

SEQ ID NO: 1695 - protein, 11 aa, Unknown
  Synthetic Peptide
NLLIFHINGKI

SEQ ID NO: 1696 - protein, 8 aa, Unknown
  Synthetic Peptide
NVEGRRDI

SEQ ID NO: 1697 - protein, 10 aa, Unknown
  Synthetic Peptide
NVKNVSQTNF

SEQ ID NO: 1698 - protein, 8 aa, Unknown
  Synthetic Peptide
PIVQYDNF

SEQ ID NO: 1699 - protein, 9 aa, Unknown
  Synthetic Peptide
QISKYEDEI

SEQ ID NO: 1700 - protein, 10 aa, Unknown
  Synthetic Peptide
QIVDELSEDI

SEQ ID NO: 1701 - protein, 9 aa, Unknown
  Synthetic Peptide
QVNKEKEKF

SEQ ID NO: 1702 - protein, 10 aa, Unknown
  Synthetic Peptide
QVNKEKEKFI

SEQ ID NO: 1703 - protein, 11 aa, Unknown
  Synthetic Peptide
SIIEKTNRESI

SEQ ID NO: 1704 - protein, 8 aa, Unknown
  Synthetic Peptide
SLLRNLGV

SEQ ID NO: 1705 - protein, 10 aa, Unknown
  Synthetic Peptide
SLYDEHIKKY

SEQ ID NO: 1706 - protein, 10 aa, Unknown
  Synthetic Peptide
TLETVNISDV

SEQ ID NO: 1707 - protein, 8 aa, Unknown
  Synthetic Peptide
TMSNVKNV

SEQ ID NO: 1708 - protein, 10 aa, Unknown
  Synthetic Peptide
TVNISDVNDF

SEQ ID NO: 1709 - protein, 9 aa, Unknown
  Synthetic Peptide
YISFYFILV

SEQ ID NO: 1710 - protein, 10 aa, Unknown
  Synthetic Peptide
ALLACAGLAY

SEQ ID NO: 1711 - protein, 9 aa, Unknown
  Synthetic Peptide
AVFGIGQGI

SEQ ID NO: 1712 - protein, 11 aa, Unknown
  Synthetic Peptide
AVFGIGQGINV

SEQ ID NO: 1713 - protein, 9 aa, Unknown
  Synthetic Peptide
AVPLAMKLI

SEQ ID NO: 1714 - protein, 8 aa, Unknown
  Synthetic Peptide
DLDEPEQF

SEQ ID NO: 1715 - protein, 10 aa, Unknown
  Synthetic Peptide
DLFLVNGRDV

SEQ ID NO: 1716 - protein, 10 aa, Unknown
  Synthetic Peptide
DQPRPRGDNF

SEQ ID NO: 1717 - protein, 10 aa, Unknown
  Synthetic Peptide
DVQNNIVDEI

SEQ ID NO: 1718 - protein, 8 aa, Unknown
  Synthetic Peptide
EIKYREEV

SEQ ID NO: 1719 - protein, 11 aa, Unknown
  Synthetic Peptide
EQFRLPEENEW

SEQ ID NO: 1720 - protein, 10 aa, Unknown
  Synthetic Peptide
EVCNDEVDLY

SEQ ID NO: 1721 - protein, 8 aa, Unknown
  Synthetic Peptide
EVDLYLLM

SEQ ID NO: 1722 - protein, 10 aa, Unknown
  Synthetic Peptide
EVEKTASCGV

SEQ ID NO: 1723 - protein, 11 aa, Unknown
  Synthetic Peptide
EVEKTASCGVW

SEQ ID NO: 1724 - protein, 8 aa, Unknown
  Synthetic Peptide
FLIFFDLF

SEQ ID NO: 1725 - protein, 10 aa, Unknown
  Synthetic Peptide
FLIFFDLFLV

SEQ ID NO: 1726 - protein, 8 aa, Unknown
  Synthetic Peptide
FLVNGRDV

SEQ ID NO: 1727 - protein, 9 aa, Unknown
  Synthetic Peptide
FMKAVCVEV

SEQ ID NO: 1728 - protein, 10 aa, Unknown
  Synthetic Peptide
FVVPGAATPY

SEQ ID NO: 1729 - protein, 8 aa, Unknown
  Synthetic Peptide
GIGQGINV

SEQ ID NO: 1730 - protein, 10 aa, Unknown
  Synthetic Peptide
GIGQGINVAF

SEQ ID NO: 1731 - protein, 9 aa, Unknown
  Synthetic Peptide
GINVAFNRF

SEQ ID NO: 1732 - protein, 11 aa, Unknown
  Synthetic Peptide
GINVAFNRFLV

SEQ ID NO: 1733 - protein, 8 aa, Unknown
  Synthetic Peptide
GLAYKFVV

SEQ ID NO: 1734 - protein, 9 aa, Unknown
  Synthetic Peptide
GPFMKAVCV

SEQ ID NO: 1735 - protein, 11 aa, Unknown
  Synthetic Peptide
GPFMKAVCVEV

SEQ ID NO: 1736 - protein, 8 aa, Unknown
  Synthetic Peptide
GQGINVAF

SEQ ID NO: 1737 - protein, 11 aa, Unknown
  Synthetic Peptide
GQGINVAFNRF

SEQ ID NO: 1738 - protein, 9 aa, Unknown
  Synthetic Peptide
GVKIAVFGI

SEQ ID NO: 1739 - protein, 11 aa, Unknown
  Synthetic Peptide
GVWDEWSPCSV

SEQ ID NO: 1740 - protein, 9 aa, Unknown
  Synthetic Peptide
HLGNVKYLV

SEQ ID NO: 1741 - protein, 10 aa, Unknown
  Synthetic Peptide
HLGNVKYLVI

SEQ ID NO: 1742 - protein, 11 aa, Unknown
  Synthetic Peptide
HLGNVKYLVIV

SEQ ID NO: 1743 - protein, 10 aa, Unknown
  Synthetic Peptide
HPSDGKCNLY

SEQ ID NO: 1744 - protein, 10 aa, Unknown
  Synthetic Peptide
ILTDGIPDSI

SEQ ID NO: 1745 - protein, 9 aa, Unknown
  Synthetic Peptide
IPEDSEKEV

SEQ ID NO: 1746 - protein, 11 aa, Unknown
  Synthetic Peptide
IVDEIKYREEV

SEQ ID NO: 1747 - protein, 10 aa, Unknown
  Synthetic Peptide
IVFLIFFDLF

SEQ ID NO: 1748 - protein, 11 aa, Unknown
  Synthetic Peptide
KIAVFGIGQGI

SEQ ID NO: 1749 - protein, 9 aa, Unknown
  Synthetic Peptide
LIFFDLFLV

SEQ ID NO: 1750 - protein, 9 aa, Unknown
  Synthetic Peptide
LLACAGLAY

SEQ ID NO: 1751 - protein, 11 aa, Unknown
  Synthetic Peptide
LLACAGLAYKF

SEQ ID NO: 1752 - protein, 9 aa, Unknown
  Synthetic Peptide
LLMDCSGSI

SEQ ID NO: 1753 - protein, 8 aa, Unknown
  Synthetic Peptide
LLSTNLPY

SEQ ID NO: 1754 - protein, 8 aa, Unknown
  Synthetic Peptide
LMDCSGSI

SEQ ID NO: 1755 - protein, 11 aa, Unknown
  Synthetic Peptide
LQVRKHLNDRI

SEQ ID NO: 1756 - protein, 8 aa, Unknown
  Synthetic Peptide
LVIVFLIF

SEQ ID NO: 1757 - protein, 9 aa, Unknown
  Synthetic Peptide
LVIVFLIFF

SEQ ID NO: 1758 - protein, 11 aa, Unknown
  Synthetic Peptide
LVNGRDVQNNI

SEQ ID NO: 1759 - protein, 9 aa, Unknown
  Synthetic Peptide
LVVILTDGI

SEQ ID NO: 1760 - protein, 10 aa, Unknown
  Synthetic Peptide
NIPEDSEKEV

SEQ ID NO: 1761 - protein, 8 aa, Unknown
  Synthetic Peptide
NIVDEIKY

SEQ ID NO: 1762 - protein, 8 aa, Unknown
  Synthetic Peptide
NLYADSAW

SEQ ID NO: 1763 - protein, 11 aa, Unknown
  Synthetic Peptide
NLYADSAWENV

SEQ ID NO: 1764 - protein, 10 aa, Unknown
  Synthetic Peptide
NPEDDREENF

SEQ ID NO: 1765 - protein, 11 aa, Unknown
  Synthetic Peptide
NQLVVILTDGI

SEQ ID NO: 1766 - protein, 9 aa, Unknown
  Synthetic Peptide
NVAFNRFLV

SEQ ID NO: 1767 - protein, 10 aa, Unknown
  Synthetic Peptide
NVIGPFMKAV

SEQ ID NO: 1768 - protein, 9 aa, Unknown
  Synthetic Peptide
NVKNVIGPF

SEQ ID NO: 1769 - protein, 10 aa, Unknown
  Synthetic Peptide
NVKNVIGPFM

SEQ ID NO: 1770 - protein, 8 aa, Unknown
  Synthetic Peptide
NVKYLVIV

SEQ ID NO: 1771 - protein, 9 aa, Unknown
  Synthetic Peptide
NVKYLVIVF

SEQ ID NO: 1772 - protein, 11 aa, Unknown
  Synthetic Peptide
NVKYLVIVFLI

SEQ ID NO: 1773 - protein, 10 aa, Unknown
  Synthetic Peptide
QLVVILTDGI

SEQ ID NO: 1774 - protein, 9 aa, Unknown
  Synthetic Peptide
QPRPRGDNF

SEQ ID NO: 1775 - protein, 11 aa, Unknown
  Synthetic Peptide
QPRPRGDNFAV

SEQ ID NO: 1776 - protein, 10 aa, Unknown
  Synthetic Peptide
QVRKHLNDRI

SEQ ID NO: 1777 - protein, 11 aa, Unknown
  Synthetic Peptide
RINRENANQLV

SEQ ID NO: 1778 - protein, 8 aa, Unknown
  Synthetic Peptide
RLPEENEW

SEQ ID NO: 1779 - protein, 9 aa, Unknown
  Synthetic Peptide
RPRGDNFAV

SEQ ID NO: 1780 - protein, 8 aa, Unknown
  Synthetic Peptide
SIRRHNWV

SEQ ID NO: 1781 - protein, 9 aa, Unknown
  Synthetic Peptide
SLLSTNLPY

SEQ ID NO: 1782 - protein, 10 aa, Unknown
  Synthetic Peptide
SQDNNGNRHV

SEQ ID NO: 1783 - protein, 10 aa, Unknown
  Synthetic Peptide
TPYAGEPAPF

SEQ ID NO: 1784 - protein, 9 aa, Unknown
  Synthetic Peptide
VIGPFMKAV

SEQ ID NO: 1785 - protein, 11 aa, Unknown
  Synthetic Peptide
VIGPFMKAVCV

SEQ ID NO: 1786 - protein, 11 aa, Unknown
  Synthetic Peptide
VILTDGIPDSI

SEQ ID NO: 1787 - protein, 8 aa, Unknown
  Synthetic Peptide
VIVFLIFF

SEQ ID NO: 1788 - protein, 11 aa, Unknown
  Synthetic Peptide
VIVFLIFFDLF

SEQ ID NO: 1789 - protein, 8 aa, Unknown
  Synthetic Peptide
VPGAATPY

SEQ ID NO: 1790 - protein, 8 aa, Unknown
  Synthetic Peptide
VPLAMKLI

SEQ ID NO: 1791 - protein, 9 aa, Unknown
  Synthetic Peptide
VQNNIVDEI

SEQ ID NO: 1792 - protein, 11 aa, Unknown
  Synthetic Peptide
VQNNIVDEIKY

SEQ ID NO: 1793 - protein, 8 aa, Unknown
  Synthetic Peptide
VVILTDGI

SEQ ID NO: 1794 - protein, 9 aa, Unknown
  Synthetic Peptide
VVPGAATPY

SEQ ID NO: 1795 - protein, 10 aa, Unknown
  Synthetic Peptide
WVNHAVPLAM

SEQ ID NO: 1796 - protein, 10 aa, Unknown
  Synthetic Peptide
YLLMDCSGSI

SEQ ID NO: 1797 - protein, 8 aa, Unknown
  Synthetic Peptide
YLVIVFLI

SEQ ID NO: 1798 - protein, 9 aa, Unknown
  Synthetic Peptide
YLVIVFLIF

SEQ ID NO: 1799 - protein, 10 aa, Unknown
  Synthetic Peptide
YLVIVFLIFF

SEQ ID NO: 1800 - protein, 8 aa, Unknown
  Synthetic Peptide
DNAGINLY

SEQ ID NO: 1801 - protein, 10 aa, Unknown
  Synthetic Peptide
EPSDKHIEQY

SEQ ID NO: 1802 - protein, 9 aa, Unknown
  Synthetic Peptide
FVEALFQEY

SEQ ID NO: 1803 - protein, 10 aa, Unknown
  Synthetic Peptide
NTRVLNELNY

SEQ ID NO: 1804 - protein, 10 aa, Unknown
  Synthetic Peptide
NYDNAGINLY

SEQ ID NO: 1805 - protein, 9 aa, Unknown
  Synthetic Peptide
PSDKHIEQY

SEQ ID NO: 1806 - protein, 8 aa, Unknown
  Synthetic Peptide
VEALFQEY

SEQ ID NO: 1807 - protein, 11 aa, Unknown
  Synthetic Peptide
VEALFQEYQCY

SEQ ID NO: 1808 - protein, 8 aa, Unknown
  Synthetic Peptide
YNELEMNY

SEQ ID NO: 1809 - protein, 9 aa, Unknown
  Synthetic Peptide
YNELEMNYY

SEQ ID NO: 1810 - protein, 11 aa, Unknown
  Synthetic Peptide
LVEVNKRKSKY

SEQ ID NO: 1811 - protein, 8 aa, Unknown
  Synthetic Peptide
DDDDKKKY

SEQ ID NO: 1812 - protein, 8 aa, Unknown
  Synthetic Peptide
DEENIGIY

SEQ ID NO: 1813 - protein, 11 aa, Unknown
  Synthetic Peptide
DLDEFKPIVQY

SEQ ID NO: 1814 - protein, 8 aa, Unknown
  Synthetic Peptide
EDEISAEY

SEQ ID NO: 1815 - protein, 9 aa, Unknown
  Synthetic Peptide
ELSEDITKY

SEQ ID NO: 1816 - protein, 10 aa, Unknown
  Synthetic Peptide
FQDEENIGIY

SEQ ID NO: 1817 - protein, 10 aa, Unknown
  Synthetic Peptide
HGDVLAEDLY

SEQ ID NO: 1818 - protein, 10 aa, Unknown
  Synthetic Peptide
INDDDDKKKY

SEQ ID NO: 1819 - protein, 11 aa, Unknown
  Synthetic Peptide
KSLYDEHIKKY

SEQ ID NO: 1820 - protein, 10 aa, Unknown
  Synthetic Peptide
KYEDEISAEY

SEQ ID NO: 1821 - protein, 10 aa, Unknown
  Synthetic Peptide
LDEFKPIVQY

SEQ ID NO: 1822 - protein, 9 aa, Unknown
  Synthetic Peptide
LPSENERGY

SEQ ID NO: 1823 - protein, 10 aa, Unknown
  Synthetic Peptide
LPSENERGYY

SEQ ID NO: 1824 - protein, 8 aa, Unknown
  Synthetic Peptide
LSEDITKY

SEQ ID NO: 1825 - protein, 9 aa, Unknown
  Synthetic Peptide
LYDEHIKKY

SEQ ID NO: 1826 - protein, 9 aa, Unknown
  Synthetic Peptide
NDDDDKKKY

SEQ ID NO: 1827 - protein, 8 aa, Unknown
  Synthetic Peptide
PSENERGY

SEQ ID NO: 1828 - protein, 9 aa, Unknown
  Synthetic Peptide
PSENERGYY

SEQ ID NO: 1829 - protein, 9 aa, Unknown
  Synthetic Peptide
QDEENIGIY

SEQ ID NO: 1830 - protein, 11 aa, Unknown
  Synthetic Peptide
SEEKIKKGKKY

SEQ ID NO: 1831 - protein, 11 aa, Unknown
  Synthetic Peptide
VDELSEDITKY

SEQ ID NO: 1832 - protein, 9 aa, Unknown
  Synthetic Peptide
VNDFQISKY

SEQ ID NO: 1833 - protein, 8 aa, Unknown
  Synthetic Peptide
YDEHIKKY

SEQ ID NO: 1834 - protein, 9 aa, Unknown
  Synthetic Peptide
YEDEISAEY

SEQ ID NO: 1835 - protein, 8 aa, Unknown
  Synthetic Peptide
CNDEVDLY

SEQ ID NO: 1836 - protein, 10 aa, Unknown
  Synthetic Peptide
HPSDGKCNLY

SEQ ID NO: 1837 - protein, 9 aa, Unknown
  Synthetic Peptide
LLACAGLAY

SEQ ID NO: 1838 - protein, 8 aa, Unknown
  Synthetic Peptide
LLSTNLPY

SEQ ID NO: 1839 - protein, 9 aa, Unknown
  Synthetic Peptide
PSDGKCNLY

SEQ ID NO: 1840 - protein, 8 aa, Unknown
  Synthetic Peptide
AILSVSSF

SEQ ID NO: 1841 - protein, 10 aa, Unknown
  Synthetic Peptide
AILSVSSFLF

SEQ ID NO: 1842 - protein, 9 aa, Unknown
  Synthetic Peptide
ALFQEYQCY

SEQ ID NO: 1843 - protein, 8 aa, Unknown
  Synthetic Peptide
CGNGIQVR

SEQ ID NO: 1844 - protein, 10 aa, Unknown
  Synthetic Peptide
CGNGIQVRIK

SEQ ID NO: 1845 - protein, 9 aa, Unknown
  Synthetic Peptide
DGNNEDNEK

SEQ ID NO: 1846 - protein, 11 aa, Unknown
  Synthetic Peptide
DGNNEDNEKLR

SEQ ID NO: 1847 - protein, 11 aa, Unknown
  Synthetic Peptide
DGNNNNGDNGR

SEQ ID NO: 1848 - protein, 8 aa, Unknown
  Synthetic Peptide
DGNPDPNA

SEQ ID NO: 1849 - protein, 8 aa, Unknown
  Synthetic Peptide
DIEKKICK

SEQ ID NO: 1850 - protein, 11 aa, Unknown
  Synthetic Peptide
DIEKKICKMEK

SEQ ID NO: 1851 - protein, 10 aa, Unknown
  Synthetic Peptide
EALFQEYQCY

SEQ ID NO: 1852 - protein, 8 aa, Unknown
  Synthetic Peptide
EDNEKLRK

SEQ ID NO: 1853 - protein, 10 aa, Unknown
  Synthetic Peptide
EDNEKLRKPK

SEQ ID NO: 1854 - protein, 11 aa, Unknown
  Synthetic Peptide
EDNEKLRKPKH

SEQ ID NO: 1855 - protein, 8 aa, Unknown
  Synthetic Peptide
EGKDEDKR

SEQ ID NO: 1856 - protein, 9 aa, Unknown
  Synthetic Peptide
ELEMNYYGK

SEQ ID NO: 1857 - protein, 8 aa, Unknown
  Synthetic Peptide
FLFVEALF

SEQ ID NO: 1858 - protein, 11 aa, Unknown
  Synthetic Peptide
FLFVEALFQEY

SEQ ID NO: 1859 - protein, 9 aa, Unknown
  Synthetic Peptide
FVEALFQEY

SEQ ID NO: 1860 - protein, 9 aa, Unknown
  Synthetic Peptide
GDGNPDPNA

SEQ ID NO: 1861 - protein, 8 aa, Unknown
  Synthetic Peptide
GDNGREGK

SEQ ID NO: 1862 - protein, 11 aa, Unknown
  Synthetic Peptide
GIQVRIKPGSA

SEQ ID NO: 1863 - protein, 8 aa, Unknown
  Synthetic Peptide
GLIMVLSF

SEQ ID NO: 1864 - protein, 10 aa, Unknown
  Synthetic Peptide
GLIMVLSFLF

SEQ ID NO: 1865 - protein, 8 aa, Unknown
  Synthetic Peptide
HIEQYLKK

SEQ ID NO: 1866 - protein, 11 aa, Unknown
  Synthetic Peptide
ICKMEKCSSVF

SEQ ID NO: 1867 - protein, 9 aa, Unknown
  Synthetic Peptide
IGLIMVLSF

SEQ ID NO: 1868 - protein, 11 aa, Unknown
  Synthetic Peptide
IGLIMVLSFLF

SEQ ID NO: 1869 - protein, 9 aa, Unknown
  Synthetic Peptide
ILSVSSFLF

SEQ ID NO: 1870 - protein, 8 aa, Unknown
  Synthetic Peptide
IMVLSFLF

SEQ ID NO: 1871 - protein, 10 aa, Unknown
  Synthetic Peptide
KLAILSVSSF

SEQ ID NO: 1872 - protein, 8 aa, Unknown
  Synthetic Peptide
KLRKPKHK

SEQ ID NO: 1873 - protein, 9 aa, Unknown
  Synthetic Peptide
KLRKPKHKK

SEQ ID NO: 1874 - protein, 11 aa, Unknown
  Synthetic Peptide
KLRKPKHKKLK

SEQ ID NO: 1875 - protein, 9 aa, Unknown
  Synthetic Peptide
KMEKCSSVF

SEQ ID NO: 1876 - protein, 9 aa, Unknown
  Synthetic Peptide
LAILSVSSF

SEQ ID NO: 1877 - protein, 11 aa, Unknown
  Synthetic Peptide
LAILSVSSFLF

SEQ ID NO: 1878 - protein, 9 aa, Unknown
  Synthetic Peptide
LDYENDIEK

SEQ ID NO: 1879 - protein, 10 aa, Unknown
  Synthetic Peptide
LDYENDIEKK

SEQ ID NO: 1880 - protein, 8 aa, Unknown
  Synthetic Peptide
LFQEYQCY

SEQ ID NO: 1881 - protein, 10 aa, Unknown
  Synthetic Peptide
LFVEALFQEY

SEQ ID NO: 1882 - protein, 9 aa, Unknown
  Synthetic Peptide
LIMVLSFLF

SEQ ID NO: 1883 - protein, 8 aa, Unknown
  Synthetic Peptide
LSVSSFLF

SEQ ID NO: 1884 - protein, 11 aa, Unknown
  Synthetic Peptide
LSVSSFLFVEA

SEQ ID NO: 1885 - protein, 9 aa, Unknown
  Synthetic Peptide
NANANNAVK

SEQ ID NO: 1886 - protein, 10 aa, Unknown
  Synthetic Peptide
NANPNANPNA

SEQ ID NO: 1887 - protein, 10 aa, Unknown
  Synthetic Peptide
NANPNANPNK

SEQ ID NO: 1888 - protein, 10 aa, Unknown
  Synthetic Peptide
NANPNVDPNA

SEQ ID NO: 1889 - protein, 9 aa, Unknown
  Synthetic Peptide
NDIEKKICK

SEQ ID NO: 1890 - protein, 11 aa, Unknown
  Synthetic Peptide
NDPNRNVDENA

SEQ ID NO: 1891 - protein, 9 aa, Unknown
  Synthetic Peptide
NGDNGREGK

SEQ ID NO: 1892 - protein, 8 aa, Unknown
  Synthetic Peptide
NGIQVRIK

SEQ ID NO: 1893 - protein, 10 aa, Unknown
  Synthetic Peptide
NGREGKDEDK

SEQ ID NO: 1894 - protein, 11 aa, Unknown
  Synthetic Peptide
NGREGKDEDKR

SEQ ID NO: 1895 - protein, 10 aa, Unknown
  Synthetic Peptide
NLYNELEMNY

SEQ ID NO: 1896 - protein, 11 aa, Unknown
  Synthetic Peptide
NLYNELEMNYY

SEQ ID NO: 1897 - protein, 8 aa, Unknown
  Synthetic Peptide
NMPNDPNR

SEQ ID NO: 1898 - protein, 10 aa, Unknown
  Synthetic Peptide
NTRVLNELNY

SEQ ID NO: 1899 - protein, 8 aa, Unknown
  Synthetic Peptide
NVDENANA

SEQ ID NO: 1900 - protein, 11 aa, Unknown
  Synthetic Peptide
NVDENANANNA

SEQ ID NO: 1901 - protein, 10 aa, Unknown
  Synthetic Peptide
NVDPNANPNA

SEQ ID NO: 1902 - protein, 10 aa, Unknown
  Synthetic Peptide
PGDGNPDPNA

SEQ ID NO: 1903 - protein, 9 aa, Unknown
  Synthetic Peptide
PSDKHIEQY

SEQ ID NO: 1904 - protein, 11 aa, Unknown
  Synthetic Peptide
PSDKHIEQYLK

SEQ ID NO: 1905 - protein, 10 aa, Unknown
  Synthetic Peptide
QCYGSSSNTR

SEQ ID NO: 1906 - protein, 11 aa, Unknown
  Synthetic Peptide
QGHNMPNDPNR

SEQ ID NO: 1907 - protein, 9 aa, Unknown
  Synthetic Peptide
QVRIKPGSA

SEQ ID NO: 1908 - protein, 10 aa, Unknown
  Synthetic Peptide
RDGNNEDNEK

SEQ ID NO: 1909 - protein, 8 aa, Unknown
  Synthetic Peptide
RVLNELNY

SEQ ID NO: 1910 - protein, 11 aa, Unknown
  Synthetic Peptide
RVLNELNYDNA

SEQ ID NO: 1911 - protein, 8 aa, Unknown
  Synthetic Peptide
SDKHIEQY

SEQ ID NO: 1912 - protein, 10 aa, Unknown
  Synthetic Peptide
SDKHIEQYLK

SEQ ID NO: 1913 - protein, 11 aa, Unknown
  Synthetic Peptide
SDKHIEQYLKK

SEQ ID NO: 1914 - protein, 9 aa, Unknown
  Synthetic Peptide
SFLFVEALF

SEQ ID NO: 1915 - protein, 10 aa, Unknown
  Synthetic Peptide
SIGLIMVLSF

SEQ ID NO: 1916 - protein, 8 aa, Unknown
  Synthetic Peptide
SSFLFVEA

SEQ ID NO: 1917 - protein, 10 aa, Unknown
  Synthetic Peptide
SSFLFVEALF

SEQ ID NO: 1918 - protein, 11 aa, Unknown
  Synthetic Peptide
SSIGLIMVLSF

SEQ ID NO: 1919 - protein, 10 aa, Unknown
  Synthetic Peptide
SVSSFLFVEA

SEQ ID NO: 1920 - protein, 11 aa, Unknown
  Synthetic Peptide
SVTCGNGIQVR

SEQ ID NO: 1921 - protein, 9 aa, Unknown
  Synthetic Peptide
TCGNGIQVR

SEQ ID NO: 1922 - protein, 11 aa, Unknown
  Synthetic Peptide
TCGNGIQVRIK

SEQ ID NO: 1923 - protein, 10 aa, Unknown
  Synthetic Peptide
VDENANANNA

SEQ ID NO: 1924 - protein, 9 aa, Unknown
  Synthetic Peptide
VDPNANPNA

SEQ ID NO: 1925 - protein, 10 aa, Unknown
  Synthetic Peptide
VLNELNYDNA

SEQ ID NO: 1926 - protein, 9 aa, Unknown
  Synthetic Peptide
VSSFLFVEA

SEQ ID NO: 1927 - protein, 11 aa, Unknown
  Synthetic Peptide
VSSFLFVEALF

SEQ ID NO: 1928 - protein, 10 aa, Unknown
  Synthetic Peptide
VTCGNGIQVR

SEQ ID NO: 1929 - protein, 9 aa, Unknown
  Synthetic Peptide
YDNAGINLY

SEQ ID NO: 1930 - protein, 8 aa, Unknown
  Synthetic Peptide
YGKQENWY

SEQ ID NO: 1931 - protein, 11 aa, Unknown
  Synthetic Peptide
YGKQENWYSLK

SEQ ID NO: 1932 - protein, 8 aa, Unknown
  Synthetic Peptide
YGSSSNTR

SEQ ID NO: 1933 - protein, 8 aa, Unknown
  Synthetic Peptide
YSLKKNSR

SEQ ID NO: 1934 - protein, 8 aa, Unknown
  Synthetic Peptide
ADNANPDA

SEQ ID NO: 1935 - protein, 11 aa, Unknown
  Synthetic Peptide
ADSESNGEPNA

SEQ ID NO: 1936 - protein, 9 aa, Unknown
  Synthetic Peptide
ALFFIIFNK

SEQ ID NO: 1937 - protein, 11 aa, Unknown
  Synthetic Peptide
DDNNLVSGPEH

SEQ ID NO: 1938 - protein, 8 aa, Unknown
  Synthetic Peptide
DLISDMIK

SEQ ID NO: 1939 - protein, 9 aa, Unknown
  Synthetic Peptide
DLISDMIKK

SEQ ID NO: 1940 - protein, 10 aa, Unknown
  Synthetic Peptide
DSESNGEPNA

SEQ ID NO: 1941 - protein, 11 aa, Unknown
  Synthetic Peptide
DVHDLISDMIK

SEQ ID NO: 1942 - protein, 8 aa, Unknown
  Synthetic Peptide
ELVEVNKR

SEQ ID NO: 1943 - protein, 9 aa, Unknown
  Synthetic Peptide
ELVEVNKRK

SEQ ID NO: 1944 - protein, 11 aa, Unknown
  Synthetic Peptide
ELVEVNKRKSK

SEQ ID NO: 1945 - protein, 9 aa, Unknown
  Synthetic Peptide
ESLAEKTNK

SEQ ID NO: 1946 - protein, 8 aa, Unknown
  Synthetic Peptide
ESNGEPNA

SEQ ID NO: 1947 - protein, 8 aa, Unknown
  Synthetic Peptide
EVNKRKSK

SEQ ID NO: 1948 - protein, 9 aa, Unknown
  Synthetic Peptide
EVNKRKSKY

SEQ ID NO: 1949 - protein, 10 aa, Unknown
  Synthetic Peptide
EVNKRKSKYK

SEQ ID NO: 1950 - protein, 11 aa, Unknown
  Synthetic Peptide
FFIIFNKESLA

SEQ ID NO: 1951 - protein, 10 aa, Unknown
  Synthetic Peptide
FFLALFFIIF

SEQ ID NO: 1952 - protein, 10 aa, Unknown
  Synthetic Peptide
FIIFNKESLA

SEQ ID NO: 1953 - protein, 9 aa, Unknown
  Synthetic Peptide
FLALFFIIF

SEQ ID NO: 1954 - protein, 11 aa, Unknown
  Synthetic Peptide
FLALFFIIFNK

SEQ ID NO: 1955 - protein, 8 aa, Unknown
  Synthetic Peptide
GGVGLVLY

SEQ ID NO: 1956 - protein, 9 aa, Unknown
  Synthetic Peptide
GLVLYNTEK

SEQ ID NO: 1957 - protein, 11 aa, Unknown
  Synthetic Peptide
GLVLYNTEKGR

SEQ ID NO: 1958 - protein, 10 aa, Unknown
  Synthetic Peptide
GSGEPLIDVH

SEQ ID NO: 1959 - protein, 8 aa, Unknown
  Synthetic Peptide
GSGVSSKK

SEQ ID NO: 1960 - protein, 9 aa, Unknown
  Synthetic Peptide
GSGVSSKKK

SEQ ID NO: 1961 - protein, 11 aa, Unknown
  Synthetic Peptide
GSGVSSKKKNK

SEQ ID NO: 1962 - protein, 9 aa, Unknown
  Synthetic Peptide
GSSDPADNA

SEQ ID NO: 1963 - protein, 9 aa, Unknown
  Synthetic Peptide
GTGSGVSSK

SEQ ID NO: 1964 - protein, 10 aa, Unknown
  Synthetic Peptide
GTGSGVSSKK

SEQ ID NO: 1965 - protein, 11 aa, Unknown
  Synthetic Peptide
GTGSGVSSKKK

SEQ ID NO: 1966 - protein, 11 aa, Unknown
  Synthetic Peptide
GVGLVLYNTEK

SEQ ID NO: 1967 - protein, 9 aa, Unknown
  Synthetic Peptide
GVSSKKKNK

SEQ ID NO: 1968 - protein, 10 aa, Unknown
  Synthetic Peptide
GVSSKKKNKK

SEQ ID NO: 1969 - protein, 9 aa, Unknown
  Synthetic Peptide
HDLISDMIK

SEQ ID NO: 1970 - protein, 10 aa, Unknown
  Synthetic Peptide
HDLISDMIKK

SEQ ID NO: 1971 - protein, 8 aa, Unknown
  Synthetic Peptide
IFNKESLA

SEQ ID NO: 1972 - protein, 10 aa, Unknown
  Synthetic Peptide
IFNKESLAEK

SEQ ID NO: 1973 - protein, 10 aa, Unknown
  Synthetic Peptide
IGSSDPADNA

SEQ ID NO: 1974 - protein, 9 aa, Unknown
  Synthetic Peptide
IIFNKESLA

SEQ ID NO: 1975 - protein, 11 aa, Unknown
  Synthetic Peptide
IIFNKESLAEK

SEQ ID NO: 1976 - protein, 8 aa, Unknown
  Synthetic Peptide
ILSVFFLA

SEQ ID NO: 1977 - protein, 10 aa, Unknown
  Synthetic Peptide
ILSVFFLALF

SEQ ID NO: 1978 - protein, 11 aa, Unknown
  Synthetic Peptide
ILSVFFLALFF

SEQ ID NO: 1979 - protein, 11 aa, Unknown
  Synthetic Peptide
KGSGEPLIDVH

SEQ ID NO: 1980 - protein, 10 aa, Unknown
  Synthetic Peptide
KGTGSGVSSK

SEQ ID NO: 1981 - protein, 11 aa, Unknown
  Synthetic Peptide
KGTGSGVSSKK

SEQ ID NO: 1982 - protein, 8 aa, Unknown
  Synthetic Peptide
KIGSSDPA

SEQ ID NO: 1983 - protein, 11 aa, Unknown
  Synthetic Peptide
KIGSSDPADNA

SEQ ID NO: 1984 - protein, 9 aa, Unknown
  Synthetic Peptide
KILSVFFLA

SEQ ID NO: 1985 - protein, 11 aa, Unknown
  Synthetic Peptide
KILSVFFLALF

SEQ ID NO: 1986 - protein, 8 aa, Unknown
  Synthetic Peptide
KLATSVLA

SEQ ID NO: 1987 - protein, 8 aa, Unknown
  Synthetic Peptide
LALFFIIF

SEQ ID NO: 1988 - protein, 10 aa, Unknown
  Synthetic Peptide
LALFFIIFNK

SEQ ID NO: 1989 - protein, 8 aa, Unknown
  Synthetic Peptide
LFFIIFNK

SEQ ID NO: 1990 - protein, 9 aa, Unknown
  Synthetic Peptide
LGGVGLVLY

SEQ ID NO: 1991 - protein, 8 aa, Unknown
  Synthetic Peptide
LISDMIKK

SEQ ID NO: 1992 - protein, 10 aa, Unknown
  Synthetic Peptide
LLGGVGLVLY

SEQ ID NO: 1993 - protein, 9 aa, Unknown
  Synthetic Peptide
LSVFFLALF

SEQ ID NO: 1994 - protein, 10 aa, Unknown
  Synthetic Peptide
LSVFFLALFF

SEQ ID NO: 1995 - protein, 8 aa, Unknown
  Synthetic Peptide
LVEVNKRK

SEQ ID NO: 1996 - protein, 10 aa, Unknown
  Synthetic Peptide
LVEVNKRKSK

SEQ ID NO: 1997 - protein, 11 aa, Unknown
  Synthetic Peptide
LVEVNKRKSKY

SEQ ID NO: 1998 - protein, 8 aa, Unknown
  Synthetic Peptide
LVLYNTEK

SEQ ID NO: 1999 - protein, 10 aa, Unknown
  Synthetic Peptide
LVLYNTEKGR

SEQ ID NO: 2000 - protein, 11 aa, Unknown
  Synthetic Peptide
LVLYNTEKGRH

SEQ ID NO: 2001 - protein, 8 aa, Unknown
  Synthetic Peptide
NADPQVTA

SEQ ID NO: 2002 - protein, 8 aa, Unknown
  Synthetic Peptide
NLVSGPEH

SEQ ID NO: 2003 - protein, 9 aa, Unknown
  Synthetic Peptide
NTEKGRHPF

SEQ ID NO: 2004 - protein, 10 aa, Unknown
  Synthetic Peptide
NTEKGRHPFK

SEQ ID NO: 2005 - protein, 9 aa, Unknown
  Synthetic Peptide
PADNANPDA

SEQ ID NO: 2006 - protein, 10 aa, Unknown
  Synthetic Peptide
PFKIGSSDPA

SEQ ID NO: 2007 - protein, 11 aa, Unknown
  Synthetic Peptide
SDPADNANPDA

SEQ ID NO: 2008 - protein, 9 aa, Unknown
  Synthetic Peptide
SGEPLIDVH

SEQ ID NO: 2009 - protein, 8 aa, Unknown
  Synthetic Peptide
SGVSSKKK

SEQ ID NO: 2010 - protein, 10 aa, Unknown
  Synthetic Peptide
SGVSSKKKNK

SEQ ID NO: 2011 - protein, 11 aa, Unknown
  Synthetic Peptide
SGVSSKKKNKK

SEQ ID NO: 2012 - protein, 8 aa, Unknown
  Synthetic Peptide
SLAEKTNK

SEQ ID NO: 2013 - protein, 8 aa, Unknown
  Synthetic Peptide
SSDPADNA

SEQ ID NO: 2014 - protein, 8 aa, Unknown
  Synthetic Peptide
SSKKKNKK

SEQ ID NO: 2015 - protein, 8 aa, Unknown
  Synthetic Peptide
SVFFLALF

SEQ ID NO: 2016 - protein, 9 aa, Unknown
  Synthetic Peptide
SVFFLALFF

SEQ ID NO: 2017 - protein, 8 aa, Unknown
  Synthetic Peptide
TGSGVSSK

SEQ ID NO: 2018 - protein, 9 aa, Unknown
  Synthetic Peptide
TGSGVSSKK

SEQ ID NO: 2019 - protein, 10 aa, Unknown
  Synthetic Peptide
TGSGVSSKKK

SEQ ID NO: 2020 - protein, 8 aa, Unknown
  Synthetic Peptide
VFFLALFF

SEQ ID NO: 2021 - protein, 11 aa, Unknown
  Synthetic Peptide
VFFLALFFIIF

SEQ ID NO: 2022 - protein, 10 aa, Unknown
  Synthetic Peptide
VGLVLYNTEK

SEQ ID NO: 2023 - protein, 11 aa, Unknown
  Synthetic Peptide
VLLGGVGLVLY

SEQ ID NO: 2024 - protein, 9 aa, Unknown
  Synthetic Peptide
VLYNTEKGR

SEQ ID NO: 2025 - protein, 10 aa, Unknown
  Synthetic Peptide
VLYNTEKGRH

SEQ ID NO: 2026 - protein, 8 aa, Unknown
  Synthetic Peptide
VSSKKKNK

SEQ ID NO: 2027 - protein, 9 aa, Unknown
  Synthetic Peptide
VSSKKKNKK

SEQ ID NO: 2028 - protein, 9 aa, Unknown
  Synthetic Peptide
ADTKKNLER

SEQ ID NO: 2029 - protein, 10 aa, Unknown
  Synthetic Peptide
ADTKKNLERK

SEQ ID NO: 2030 - protein, 11 aa, Unknown
  Synthetic Peptide
ADTKKNLERKK

SEQ ID NO: 2031 - protein, 10 aa, Unknown
  Synthetic Peptide
AIELPSENER

SEQ ID NO: 2032 - protein, 8 aa, Unknown
  Synthetic Peptide
DDDDKKKY

SEQ ID NO: 2033 - protein, 10 aa, Unknown
  Synthetic Peptide
DDDDKKKYIK

SEQ ID NO: 2034 - protein, 9 aa, Unknown
  Synthetic Peptide
DDDKKKYIK

SEQ ID NO: 2035 - protein, 8 aa, Unknown
  Synthetic Peptide
DDEDLDEF

SEQ ID NO: 2036 - protein, 9 aa, Unknown
  Synthetic Peptide
DDEDLDEFK

SEQ ID NO: 2037 - protein, 8 aa, Unknown
  Synthetic Peptide
DDKKKYIK

SEQ ID NO: 2038 - protein, 9 aa, Unknown
  Synthetic Peptide
DDLDEGIEK

SEQ ID NO: 2039 - protein, 9 aa, Unknown
  Synthetic Peptide
DGSIKPEQK

SEQ ID NO: 2040 - protein, 10 aa, Unknown
  Synthetic Peptide
DIHKGHLEEK

SEQ ID NO: 2041 - protein, 11 aa, Unknown
  Synthetic Peptide
DIHKGHLEEKK

SEQ ID NO: 2042 - protein, 8 aa, Unknown
  Synthetic Peptide
DITKYFMK

SEQ ID NO: 2043 - protein, 11 aa, Unknown
  Synthetic Peptide
DLDEFKPIVQY

SEQ ID NO: 2044 - protein, 8 aa, Unknown
  Synthetic Peptide
DLDEGIEK

SEQ ID NO: 2045 - protein, 8 aa, Unknown
  Synthetic Peptide
DLEEKAAK

SEQ ID NO: 2046 - protein, 8 aa, Unknown
  Synthetic Peptide
DLEQDRLA

SEQ ID NO: 2047 - protein, 9 aa, Unknown
  Synthetic Peptide
DLEQDRLAK

SEQ ID NO: 2048 - protein, 11 aa, Unknown
  Synthetic Peptide
DLEQDRLAKEK

SEQ ID NO: 2049 - protein, 8 aa, Unknown
  Synthetic Peptide
DLEQERLA

SEQ ID NO: 2050 - protein, 9 aa, Unknown
  Synthetic Peptide
DLEQERLAK

SEQ ID NO: 2051 - protein, 11 aa, Unknown
  Synthetic Peptide
DLEQERLAKEK

SEQ ID NO: 2052 - protein, 11 aa, Unknown
  Synthetic Peptide
DLEQERLANEK

SEQ ID NO: 2053 - protein, 8 aa, Unknown
  Synthetic Peptide
DLEQERRA

SEQ ID NO: 2054 - protein, 9 aa, Unknown
  Synthetic Peptide
DLEQERRAK

SEQ ID NO: 2055 - protein, 11 aa, Unknown
  Synthetic Peptide
DLEQERRAKEK

SEQ ID NO: 2056 - protein, 10 aa, Unknown
  Synthetic Peptide
DLEQRKADTK

SEQ ID NO: 2057 - protein, 11 aa, Unknown
  Synthetic Peptide
DLEQRKADTKK

SEQ ID NO: 2058 - protein, 9 aa, Unknown
  Synthetic Peptide
DLERTKASK

SEQ ID NO: 2059 - protein, 10 aa, Unknown
  Synthetic Peptide
DLYGRLEIPA

SEQ ID NO: 2060 - protein, 8 aa, Unknown
  Synthetic Peptide
DSEQERLA

SEQ ID NO: 2061 - protein, 9 aa, Unknown
  Synthetic Peptide
DSEQERLAK

SEQ ID NO: 2062 - protein, 11 aa, Unknown
  Synthetic Peptide
DSEQERLAKEK

SEQ ID NO: 2063 - protein, 10 aa, Unknown
  Synthetic Peptide
DSKEISIIEK

SEQ ID NO: 2064 - protein, 8 aa, Unknown
  Synthetic Peptide
DTKKNLER

SEQ ID NO: 2065 - protein, 9 aa, Unknown
  Synthetic Peptide
DTKKNLERK

SEQ ID NO: 2066 - protein, 10 aa, Unknown
  Synthetic Peptide
DTKKNLERKK

SEQ ID NO: 2067 - protein, 8 aa, Unknown
  Synthetic Peptide
DVLAEDLY

SEQ ID NO: 2068 - protein, 10 aa, Unknown
  Synthetic Peptide
DVLAEDLYGR

SEQ ID NO: 2069 - protein, 9 aa, Unknown
  Synthetic Peptide
DVNDFQISK

SEQ ID NO: 2070 - protein, 10 aa, Unknown
  Synthetic Peptide
DVNDFQISKY

SEQ ID NO: 2071 - protein, 9 aa, Unknown
  Synthetic Peptide
EDDEDLDEF

SEQ ID NO: 2072 - protein, 10 aa, Unknown
  Synthetic Peptide
EDDEDLDEFK

SEQ ID NO: 2073 - protein, 8 aa, Unknown
  Synthetic Peptide
EDEISAEY

SEQ ID NO: 2074 - protein, 9 aa, Unknown
  Synthetic Peptide
EDITKYFMK

SEQ ID NO: 2075 - protein, 10 aa, Unknown
  Synthetic Peptide
EDKSADIQNH

SEQ ID NO: 2076 - protein, 8 aa, Unknown
  Synthetic Peptide
EDLEEKAA

SEQ ID NO: 2077 - protein, 9 aa, Unknown
  Synthetic Peptide
EDLEEKAAK

SEQ ID NO: 2078 - protein, 11 aa, Unknown
  Synthetic Peptide
EDLYGRLEIPA

SEQ ID NO: 2079 - protein, 8 aa, Unknown
  Synthetic Peptide
EFKPIVQY

SEQ ID NO: 2080 - protein, 11 aa, Unknown
  Synthetic Peptide
EFKPIVQYDNF

SEQ ID NO: 2081 - protein, 8 aa, Unknown
  Synthetic Peptide
EGRRDIHK

SEQ ID NO: 2082 - protein, 10 aa, Unknown
  Synthetic Peptide
EGRRDIHKGH

SEQ ID NO: 2083 - protein, 8 aa, Unknown
  Synthetic Peptide
EIIKSNLR

SEQ ID NO: 2084 - protein, 10 aa, Unknown
  Synthetic Peptide
EISIIEKTNR

SEQ ID NO: 2085 - protein, 8 aa, Unknown
  Synthetic Peptide
ELEDLIEK

SEQ ID NO: 2086 - protein, 8 aa, Unknown
  Synthetic Peptide
ELPSENER

SEQ ID NO: 2087 - protein, 10 aa, Unknown
  Synthetic Peptide
ELPSENERGY

SEQ ID NO: 2088 - protein, 11 aa, Unknown
  Synthetic Peptide
ELPSENERGYY

SEQ ID NO: 2089 - protein, 8 aa, Unknown
  Synthetic Peptide
ELSEDITK

SEQ ID NO: 2090 - protein, 9 aa, Unknown
  Synthetic Peptide
ELSEDITKY

SEQ ID NO: 2091 - protein, 10 aa, Unknown
  Synthetic Peptide
ELSEDITKYF

SEQ ID NO: 2092 - protein, 8 aa, Unknown
  Synthetic Peptide
ELSEEKIK

SEQ ID NO: 2093 - protein, 9 aa, Unknown
  Synthetic Peptide
ELSEEKIKK

SEQ ID NO: 2094 - protein, 11 aa, Unknown
  Synthetic Peptide
ELSEEKIKKGK

SEQ ID NO: 2095 - protein, 8 aa, Unknown
  Synthetic Peptide
ELTMSNVK

SEQ ID NO: 2096 - protein, 10 aa, Unknown
  Synthetic Peptide
ESITTNVEGR

SEQ ID NO: 2097 - protein, 11 aa, Unknown
  Synthetic Peptide
ESITTNVEGRR

SEQ ID NO: 2098 - protein, 11 aa, Unknown
  Synthetic Peptide
ETVNISDVNDF

SEQ ID NO: 2099 - protein, 9 aa, Unknown
  Synthetic Peptide
FIKSLFHIF

SEQ ID NO: 2100 - protein, 9 aa, Unknown
  Synthetic Peptide
FILVNLLIF

SEQ ID NO: 2101 - protein, 10 aa, Unknown
  Synthetic Peptide
FILVNLLIFH

SEQ ID NO: 2102 - protein, 9 aa, Unknown
  Synthetic Peptide
FLKENKLNK

SEQ ID NO: 2103 - protein, 9 aa, Unknown
  Synthetic Peptide
GDVLAEDLY

SEQ ID NO: 2104 - protein, 11 aa, Unknown
  Synthetic Peptide
GDVLAEDLYGR

SEQ ID NO: 2105 - protein, 8 aa, Unknown
  Synthetic Peptide
GSIKPEQK

SEQ ID NO: 2106 - protein, 11 aa, Unknown
  Synthetic Peptide
GSIKPEQKEDK

SEQ ID NO: 2107 - protein, 8 aa, Unknown
  Synthetic Peptide
GSSNSRNR

SEQ ID NO: 2108 - protein, 9 aa, Unknown
  Synthetic Peptide
GVSENIFLK

SEQ ID NO: 2109 - protein, 10 aa, Unknown
  Synthetic Peptide
HGDVLAEDLY

SEQ ID NO: 2110 - protein, 9 aa, Unknown
  Synthetic Peptide
HIINDDDDK

SEQ ID NO: 2111 - protein, 10 aa, Unknown
  Synthetic Peptide
HIINDDDDKK

SEQ ID NO: 2112 - protein, 11 aa, Unknown
  Synthetic Peptide
HIINDDDDKKK

SEQ ID NO: 2113 - protein, 9 aa, Unknown
  Synthetic Peptide
HIKKYKNDK

SEQ ID NO: 2114 - protein, 8 aa, Unknown
  Synthetic Peptide
HILYISFY

SEQ ID NO: 2115 - protein, 9 aa, Unknown
  Synthetic Peptide
HILYISFYF

SEQ ID NO: 2116 - protein, 8 aa, Unknown
  Synthetic Peptide
HINGKIIK

SEQ ID NO: 2117 - protein, 11 aa, Unknown
  Synthetic Peptide
HLEEKKDGSIK

SEQ ID NO: 2118 - protein, 8 aa, Unknown
  Synthetic Peptide
HVLSHNSY

SEQ ID NO: 2119 - protein, 10 aa, Unknown
  Synthetic Peptide
HVLSHNSYEK

SEQ ID NO: 2120 - protein, 10 aa, Unknown
  Synthetic Peptide
IFHINGKIIK

SEQ ID NO: 2121 - protein, 10 aa, Unknown
  Synthetic Peptide
IFLKENKLNK

SEQ ID NO: 2122 - protein, 8 aa, Unknown
  Synthetic Peptide
IINDDDDK

SEQ ID NO: 2123 - protein, 9 aa, Unknown
  Synthetic Peptide
IINDDDDKK

SEQ ID NO: 2124 - protein, 10 aa, Unknown
  Synthetic Peptide
IINDDDDKKK

SEQ ID NO: 2125 - protein, 11 aa, Unknown
  Synthetic Peptide
IINDDDDKKKY

SEQ ID NO: 2126 - protein, 8 aa, Unknown
  Synthetic Peptide
ILVNLLIF

SEQ ID NO: 2127 - protein, 9 aa, Unknown
  Synthetic Peptide
ILVNLLIFH

SEQ ID NO: 2128 - protein, 8 aa, Unknown
  Synthetic Peptide
ILYISFYF

SEQ ID NO: 2129 - protein, 11 aa, Unknown
  Synthetic Peptide
ISDVNDFQISK

SEQ ID NO: 2130 - protein, 9 aa, Unknown
  Synthetic Peptide
ISIIEKTNR

SEQ ID NO: 2131 - protein, 10 aa, Unknown
  Synthetic Peptide
ISKYEDEISA

SEQ ID NO: 2132 - protein, 8 aa, Unknown
  Synthetic Peptide
ITTNVEGR

SEQ ID NO: 2133 - protein, 9 aa, Unknown
  Synthetic Peptide
ITTNVEGRR

SEQ ID NO: 2134 - protein, 11 aa, Unknown
  Synthetic Peptide
IVDELSEDITK

SEQ ID NO: 2135 - protein, 10 aa, Unknown
  Synthetic Peptide
KADTKKNLER

SEQ ID NO: 2136 - protein, 11 aa, Unknown
  Synthetic Peptide
KADTKKNLERK

SEQ ID NO: 2137 - protein, 10 aa, Unknown
  Synthetic Peptide
KDEIIKSNLR

SEQ ID NO: 2138 - protein, 10 aa, Unknown
  Synthetic Peptide
KDGSIKPEQK

SEQ ID NO: 2139 - protein, 11 aa, Unknown
  Synthetic Peptide
KDKELTMSNVK

SEQ ID NO: 2140 - protein, 10 aa, Unknown
  Synthetic Peptide
KDNNFKPNDK

SEQ ID NO: 2141 - protein, 8 aa, Unknown
  Synthetic Peptide
KFIKSLFH

SEQ ID NO: 2142 - protein, 10 aa, Unknown
  Synthetic Peptide
KFIKSLFHIF

SEQ ID NO: 2143 - protein, 8 aa, Unknown
  Synthetic Peptide
KGHLEEKK

SEQ ID NO: 2144 - protein, 9 aa, Unknown
  Synthetic Peptide
KGKKYEKTK

SEQ ID NO: 2145 - protein, 8 aa, Unknown
  Synthetic Peptide
KIIKNSEK

SEQ ID NO: 2146 - protein, 8 aa, Unknown
  Synthetic Peptide
KIKKGKKY

SEQ ID NO: 2147 - protein, 10 aa, Unknown
  Synthetic Peptide
KIKKGKKYEK

SEQ ID NO: 2148 - protein, 11 aa, Unknown
  Synthetic Peptide
KLNKEGKLIEH

SEQ ID NO: 2149 - protein, 11 aa, Unknown
  Synthetic Peptide
KLQEQQSDLER

SEQ ID NO: 2150 - protein, 8 aa, Unknown
  Synthetic Peptide
KSADIQNH

SEQ ID NO: 2151 - protein, 9 aa, Unknown
  Synthetic Peptide
KSLYDEHIK

SEQ ID NO: 2152 - protein, 10 aa, Unknown
  Synthetic Peptide
KSLYDEHIKK

SEQ ID NO: 2153 - protein, 11 aa, Unknown
  Synthetic Peptide
KSLYDEHIKKY

SEQ ID NO: 2154 - protein, 10 aa, Unknown
  Synthetic Peptide
KSSEELSEEK

SEQ ID NO: 2155 - protein, 8 aa, Unknown
  Synthetic Peptide
KTKDNNFK

SEQ ID NO: 2156 - protein, 9 aa, Unknown
  Synthetic Peptide
KTKNNENNK

SEQ ID NO: 2157 - protein, 10 aa, Unknown
  Synthetic Peptide
KTKNNENNKF

SEQ ID NO: 2158 - protein, 11 aa, Unknown
  Synthetic Peptide
KTKNNENNKFF

SEQ ID NO: 2159 - protein, 8 aa, Unknown
  Synthetic Peptide
LAEDLYGR

SEQ ID NO: 2160 - protein, 11 aa, Unknown
  Synthetic Peptide
LAKEKLQEQQR

SEQ ID NO: 2161 - protein, 11 aa, Unknown
  Synthetic Peptide
LANEKLQEQQR

SEQ ID NO: 2162 - protein, 10 aa, Unknown
  Synthetic Peptide
LDDLDEGIEK

SEQ ID NO: 2163 - protein, 10 aa, Unknown
  Synthetic Peptide
LDEFKPIVQY

SEQ ID NO: 2164 - protein, 8 aa, Unknown
  Synthetic Peptide
LGVSENIF

SEQ ID NO: 2165 - protein, 10 aa, Unknown
  Synthetic Peptide
LGVSENIFLK

SEQ ID NO: 2166 - protein, 8 aa, Unknown
  Synthetic Peptide
LIFHINGK

SEQ ID NO: 2167 - protein, 11 aa, Unknown
  Synthetic Peptide
LIFHINGKIIK

SEQ ID NO: 2168 - protein, 9 aa, Unknown
  Synthetic Peptide
LLIFHINGK

SEQ ID NO: 2169 - protein, 8 aa, Unknown
  Synthetic Peptide
LSEDITKY

SEQ ID NO: 2170 - protein, 9 aa, Unknown
  Synthetic Peptide
LSEDITKYF

SEQ ID NO: 2171 - protein, 11 aa, Unknown
  Synthetic Peptide
LSEDITKYFMK

SEQ ID NO: 2172 - protein, 8 aa, Unknown
  Synthetic Peptide
LSEEKIKK

SEQ ID NO: 2173 - protein, 10 aa, Unknown
  Synthetic Peptide
LSEEKIKKGK

SEQ ID NO: 2174 - protein, 11 aa, Unknown
  Synthetic Peptide
LSEEKIKKGKK

SEQ ID NO: 2175 - protein, 8 aa, Unknown
  Synthetic Peptide
LSHNSYEK

SEQ ID NO: 2176 - protein, 10 aa, Unknown
  Synthetic Peptide
LSHNSYEKTK

SEQ ID NO: 2177 - protein, 8 aa, Unknown
  Synthetic Peptide
LVNLLIFH

SEQ ID NO: 2178 - protein, 8 aa, Unknown
  Synthetic Peptide
NDDDDKKK

SEQ ID NO: 2179 - protein, 9 aa, Unknown
  Synthetic Peptide
NDDDDKKKY

SEQ ID NO: 2180 - protein, 11 aa, Unknown
  Synthetic Peptide
NDDDDKKKYIK

SEQ ID NO: 2181 - protein, 8 aa, Unknown
  Synthetic Peptide
NDFQISKY

SEQ ID NO: 2182 - protein, 9 aa, Unknown
  Synthetic Peptide
NDKQVNKEK

SEQ ID NO: 2183 - protein, 11 aa, Unknown
  Synthetic Peptide
NDKQVNKEKEK

SEQ ID NO: 2184 - protein, 9 aa, Unknown
  Synthetic Peptide
NDKSLYDEH

SEQ ID NO: 2185 - protein, 11 aa, Unknown
  Synthetic Peptide
NDKSLYDEHIK

SEQ ID NO: 2186 - protein, 10 aa, Unknown
  Synthetic Peptide
NFKPNDKSLY

SEQ ID NO: 2187 - protein, 11 aa, Unknown
  Synthetic Peptide
NFQDEENIGIY

SEQ ID NO: 2188 - protein, 10 aa, Unknown
  Synthetic Peptide
NGKIIKNSEK

SEQ ID NO: 2189 - protein, 8 aa, Unknown
  Synthetic Peptide
NIFLKENK

SEQ ID NO: 2190 - protein, 11 aa, Unknown
  Synthetic Peptide
NIFLKENKLNK

SEQ ID NO: 2191 - protein, 8 aa, Unknown
  Synthetic Peptide
NISDVNDF

SEQ ID NO: 2192 - protein, 11 aa, Unknown
  Synthetic Peptide
NLDDLDEGIEK

SEQ ID NO: 2193 - protein, 8 aa, Unknown
  Synthetic Peptide
NLERKKEH

SEQ ID NO: 2194 - protein, 9 aa, Unknown
  Synthetic Peptide
NLGVSENIF

SEQ ID NO: 2195 - protein, 11 aa, Unknown
  Synthetic Peptide
NLGVSENIFLK

SEQ ID NO: 2196 - protein, 10 aa, Unknown
  Synthetic Peptide
NLLIFHINGK

SEQ ID NO: 2197 - protein, 10 aa, Unknown
  Synthetic Peptide
NLRSGSSNSR

SEQ ID NO: 2198 - protein, 9 aa, Unknown
  Synthetic Peptide
NSEKDEIIK

SEQ ID NO: 2199 - protein, 10 aa, Unknown
  Synthetic Peptide
NSRNRINEEK

SEQ ID NO: 2200 - protein, 11 aa, Unknown
  Synthetic Peptide
NSRNRINEEKH

SEQ ID NO: 2201 - protein, 9 aa, Unknown
  Synthetic Peptide
NVEGRRDIH

SEQ ID NO: 2202 - protein, 10 aa, Unknown
  Synthetic Peptide
NVEGRRDIHK

SEQ ID NO: 2203 - protein, 10 aa, Unknown
  Synthetic Peptide
NVKNVSQTNF

SEQ ID NO: 2204 - protein, 11 aa, Unknown
  Synthetic Peptide
NVKNVSQTNFK

SEQ ID NO: 2205 - protein, 8 aa, Unknown
  Synthetic Peptide
NVSQTNFK

SEQ ID NO: 2206 - protein, 11 aa, Unknown
  Synthetic Peptide
PAIELPSENER

SEQ ID NO: 2207 - protein, 8 aa, Unknown
  Synthetic Peptide
PIVQYDNF

SEQ ID NO: 2208 - protein, 8 aa, Unknown
  Synthetic Peptide
PSENERGY

SEQ ID NO: 2209 - protein, 9 aa, Unknown
  Synthetic Peptide
PSENERGYY

SEQ ID NO: 2210 - protein, 9 aa, Unknown
  Synthetic Peptide
QDEENIGIY

SEQ ID NO: 2211 - protein, 10 aa, Unknown
  Synthetic Peptide
QDEENIGIYK

SEQ ID NO: 2212 - protein, 8 aa, Unknown
  Synthetic Peptide
QDNRGNSR

SEQ ID NO: 2213 - protein, 11 aa, Unknown
  Synthetic Peptide
QDNRGNSRDSK

SEQ ID NO: 2214 - protein, 8 aa, Unknown
  Synthetic Peptide
QDRLAKEK

SEQ ID NO: 2215 - protein, 11 aa, Unknown
  Synthetic Peptide
QGQQSDLEQER

SEQ ID NO: 2216 - protein, 11 aa, Unknown
  Synthetic Peptide
QISKYEDEISA

SEQ ID NO: 2217 - protein, 8 aa, Unknown
  Synthetic Peptide
QSDLEQDR

SEQ ID NO: 2218 - protein, 10 aa, Unknown
  Synthetic Peptide
QSDLEQDRLA

SEQ ID NO: 2219 - protein, 11 aa, Unknown
  Synthetic Peptide
QSDLEQDRLAK

SEQ ID NO: 2220 - protein, 8 aa, Unknown
  Synthetic Peptide
QSDLEQER

SEQ ID NO: 2221 - protein, 10 aa, Unknown
  Synthetic Peptide
QSDLEQERLA

SEQ ID NO: 2222 - protein, 11 aa, Unknown
  Synthetic Peptide
QSDLEQERLAK

SEQ ID NO: 2223 - protein, 9 aa, Unknown
  Synthetic Peptide
QSDLEQERR

SEQ ID NO: 2224 - protein, 10 aa, Unknown
  Synthetic Peptide
QSDLEQERRA

SEQ ID NO: 2225 - protein, 11 aa, Unknown
  Synthetic Peptide
QSDLEQERRAK

SEQ ID NO: 2226 - protein, 8 aa, Unknown
  Synthetic Peptide
QSDLERTK

SEQ ID NO: 2227 - protein, 9 aa, Unknown
  Synthetic Peptide
QSDLERTKA

SEQ ID NO: 2228 - protein, 11 aa, Unknown
  Synthetic Peptide
QSDLERTKASK

SEQ ID NO: 2229 - protein, 8 aa, Unknown
  Synthetic Peptide
QSDSEQER

SEQ ID NO: 2230 - protein, 10 aa, Unknown
  Synthetic Peptide
QSDSEQERLA

SEQ ID NO: 2231 - protein, 11 aa, Unknown
  Synthetic Peptide
QSDSEQERLAK

SEQ ID NO: 2232 - protein, 9 aa, Unknown
  Synthetic Peptide
QSSLPQDNR

SEQ ID NO: 2233 - protein, 9 aa, Unknown
  Synthetic Peptide
QTNFKSLLR

SEQ ID NO: 2234 - protein, 8 aa, Unknown
  Synthetic Peptide
QVNKEKEK

SEQ ID NO: 2235 - protein, 9 aa, Unknown
  Synthetic Peptide
QVNKEKEKF

SEQ ID NO: 2236 - protein, 11 aa, Unknown
  Synthetic Peptide
QVNKEKEKFIK

SEQ ID NO: 2237 - protein, 11 aa, Unknown
  Synthetic Peptide
RDIHKGHLEEK

SEQ ID NO: 2238 - protein, 9 aa, Unknown
  Synthetic Peptide
RDLEQERLA

SEQ ID NO: 2239 - protein, 10 aa, Unknown
  Synthetic Peptide
RDLEQERLAK

SEQ ID NO: 2240 - protein, 8 aa, Unknown
  Synthetic Peptide
RDLEQERR

SEQ ID NO: 2241 - protein, 9 aa, Unknown
  Synthetic Peptide
RDLEQERRA

SEQ ID NO: 2242 - protein, 10 aa, Unknown
  Synthetic Peptide
RDLEQERRAK

SEQ ID NO: 2243 - protein, 8 aa, Unknown
  Synthetic Peptide
RDLEQRKA

SEQ ID NO: 2244 - protein, 11 aa, Unknown
  Synthetic Peptide
RDLEQRKADTK

SEQ ID NO: 2245 - protein, 11 aa, Unknown
  Synthetic Peptide
RDSKEISIIEK

SEQ ID NO: 2246 - protein, 8 aa, Unknown
  Synthetic Peptide
RGNSRDSK

SEQ ID NO: 2247 - protein, 9 aa, Unknown
  Synthetic Peptide
RINEEKHEK

SEQ ID NO: 2248 - protein, 10 aa, Unknown
  Synthetic Peptide
RINEEKHEKK

SEQ ID NO: 2249 - protein, 11 aa, Unknown
  Synthetic Peptide
RINEEKHEKKH

SEQ ID NO: 2250 - protein, 8 aa, Unknown
  Synthetic Peptide
RSGSSNSR

SEQ ID NO: 2251 - protein, 10 aa, Unknown
  Synthetic Peptide
RSGSSNSRNR

SEQ ID NO: 2252 - protein, 9 aa, Unknown
  Synthetic Peptide
SDLEQDRLA

SEQ ID NO: 2253 - protein, 10 aa, Unknown
  Synthetic Peptide
SDLEQDRLAK

SEQ ID NO: 2254 - protein, 9 aa, Unknown
  Synthetic Peptide
SDLEQERLA

SEQ ID NO: 2255 - protein, 10 aa, Unknown
  Synthetic Peptide
SDLEQERLAK

SEQ ID NO: 2256 - protein, 8 aa, Unknown
  Synthetic Peptide
SDLEQERR

SEQ ID NO: 2257 - protein, 9 aa, Unknown
  Synthetic Peptide
SDLEQERRA

SEQ ID NO: 2258 - protein, 10 aa, Unknown
  Synthetic Peptide
SDLEQERRAK

SEQ ID NO: 2259 - protein, 8 aa, Unknown
  Synthetic Peptide
SDLERTKA

SEQ ID NO: 2260 - protein, 10 aa, Unknown
  Synthetic Peptide
SDLERTKASK

SEQ ID NO: 2261 - protein, 9 aa, Unknown
  Synthetic Peptide
SDSEQERLA

SEQ ID NO: 2262 - protein, 10 aa, Unknown
  Synthetic Peptide
SDSEQERLAK

SEQ ID NO: 2263 - protein, 10 aa, Unknown
  Synthetic Peptide
SDVNDFQISK

SEQ ID NO: 2264 - protein, 11 aa, Unknown
  Synthetic Peptide
SDVNDFQISKY

SEQ ID NO: 2265 - protein, 9 aa, Unknown
  Synthetic Peptide
SGSSNSRNR

SEQ ID NO: 2266 - protein, 8 aa, Unknown
  Synthetic Peptide
SIIEKTNR

SEQ ID NO: 2267 - protein, 10 aa, Unknown
  Synthetic Peptide
SIKPEQKEDK

SEQ ID NO: 2268 - protein, 9 aa, Unknown
  Synthetic Peptide
SITTNVEGR

SEQ ID NO: 2269 - protein, 10 aa, Unknown
  Synthetic Peptide
SITTNVEGRR

SEQ ID NO: 2270 - protein, 11 aa, Unknown
  Synthetic Peptide
SLPQDNRGNSR

SEQ ID NO: 2271 - protein, 8 aa, Unknown
  Synthetic Peptide
SLYDEHIK

SEQ ID NO: 2272 - protein, 9 aa, Unknown
  Synthetic Peptide
SLYDEHIKK

SEQ ID NO: 2273 - protein, 10 aa, Unknown
  Synthetic Peptide
SLYDEHIKKY

SEQ ID NO: 2274 - protein, 11 aa, Unknown
  Synthetic Peptide
SLYDEHIKKYK

SEQ ID NO: 2275 - protein, 9 aa, Unknown
  Synthetic Peptide
SSEELSEEK

SEQ ID NO: 2276 - protein, 11 aa, Unknown
  Synthetic Peptide
SSEELSEEKIK

SEQ ID NO: 2277 - protein, 8 aa, Unknown
  Synthetic Peptide
SSLPQDNR

SEQ ID NO: 2278 - protein, 8 aa, Unknown
  Synthetic Peptide
TTNVEGRR

SEQ ID NO: 2279 - protein, 11 aa, Unknown
  Synthetic Peptide
TTNVEGRRDIH

SEQ ID NO: 2280 - protein, 10 aa, Unknown
  Synthetic Peptide
TVNISDVNDF

SEQ ID NO: 2281 - protein, 10 aa, Unknown
  Synthetic Peptide
VDELSEDITK

SEQ ID NO: 2282 - protein, 11 aa, Unknown
  Synthetic Peptide
VDELSEDITKY

SEQ ID NO: 2283 - protein, 9 aa, Unknown
  Synthetic Peptide
VLAEDLYGR

SEQ ID NO: 2284 - protein, 9 aa, Unknown
  Synthetic Peptide
VLSHNSYEK

SEQ ID NO: 2285 - protein, 11 aa, Unknown
  Synthetic Peptide
VLSHNSYEKTK

SEQ ID NO: 2286 - protein, 8 aa, Unknown
  Synthetic Peptide
VSENIFLK

SEQ ID NO: 2287 - protein, 11 aa, Unknown
  Synthetic Peptide
VSENIFLKENK

SEQ ID NO: 2288 - protein, 11 aa, Unknown
  Synthetic Peptide
VSQTNFKSLLR

SEQ ID NO: 2289 - protein, 8 aa, Unknown
  Synthetic Peptide
YDEHIKKY

SEQ ID NO: 2290 - protein, 9 aa, Unknown
  Synthetic Peptide
YDEHIKKYK

SEQ ID NO: 2291 - protein, 10 aa, Unknown
  Synthetic Peptide
YFILVNLLIF

SEQ ID NO: 2292 - protein, 11 aa, Unknown
  Synthetic Peptide
YFILVNLLIFH

SEQ ID NO: 2293 - protein, 8 aa, Unknown
  Synthetic Peptide
YGRLEIPA

SEQ ID NO: 2294 - protein, 9 aa, Unknown
  Synthetic Peptide
YIKGQDENR

SEQ ID NO: 2295 - protein, 10 aa, Unknown
  Synthetic Peptide
AATPYAGEPA

SEQ ID NO: 2296 - protein, 8 aa, Unknown
  Synthetic Peptide
ACAGLAYK

SEQ ID NO: 2297 - protein, 9 aa, Unknown
  Synthetic Peptide
ACAGLAYKF

SEQ ID NO: 2298 - protein, 9 aa, Unknown
  Synthetic Peptide
ADSAWENVK

SEQ ID NO: 2299 - protein, 10 aa, Unknown
  Synthetic Peptide
AFNRFLVGCH

SEQ ID NO: 2300 - protein, 9 aa, Unknown
  Synthetic Peptide
AGGIAGGLA

SEQ ID NO: 2301 - protein, 8 aa, Unknown
  Synthetic Peptide
AGGLALLA

SEQ ID NO: 2302 - protein, 10 aa, Unknown
  Synthetic Peptide
AGGLALLACA

SEQ ID NO: 2303 - protein, 9 aa, Unknown
  Synthetic Peptide
ALLACAGLA

SEQ ID NO: 2304 - protein, 10 aa, Unknown
  Synthetic Peptide
ALLACAGLAY

SEQ ID NO: 2305 - protein, 11 aa, Unknown
  Synthetic Peptide
ALLACAGLAYK

SEQ ID NO: 2306 - protein, 8 aa, Unknown
  Synthetic Peptide
ALLQVRKH

SEQ ID NO: 2307 - protein, 8 aa, Unknown
  Synthetic Peptide
ASKNKEKA

SEQ ID NO: 2308 - protein, 9 aa, Unknown
  Synthetic Peptide
ATPYAGEPA

SEQ ID NO: 2309 - protein, 11 aa, Unknown
  Synthetic Peptide
ATPYAGEPAPF

SEQ ID NO: 2310 - protein, 8 aa, Unknown
  Synthetic Peptide
AVCVEVEK

SEQ ID NO: 2311 - protein, 10 aa, Unknown
  Synthetic Peptide
AVCVEVEKTA

SEQ ID NO: 2312 - protein, 8 aa, Unknown
  Synthetic Peptide
CAGLAYKF

SEQ ID NO: 2313 - protein, 8 aa, Unknown
  Synthetic Peptide
CGKGTRSR

SEQ ID NO: 2314 - protein, 9 aa, Unknown
  Synthetic Peptide
CGKGTRSRK

SEQ ID NO: 2315 - protein, 10 aa, Unknown
  Synthetic Peptide
CGKGTRSRKR

SEQ ID NO: 2316 - protein, 8 aa, Unknown
  Synthetic Peptide
CSGSIRRH

SEQ ID NO: 2317 - protein, 10 aa, Unknown
  Synthetic Peptide
CSVTCGKGTR

SEQ ID NO: 2318 - protein, 8 aa, Unknown
  Synthetic Peptide
CVEVEKTA

SEQ ID NO: 2319 - protein, 8 aa, Unknown
  Synthetic Peptide
DALLQVRK

SEQ ID NO: 2320 - protein, 9 aa, Unknown
  Synthetic Peptide
DALLQVRKH

SEQ ID NO: 2321 - protein, 8 aa, Unknown
  Synthetic Peptide
DASKNKEK

SEQ ID NO: 2322 - protein, 9 aa, Unknown
  Synthetic Peptide
DASKNKEKA

SEQ ID NO: 2323 - protein, 8 aa, Unknown
  Synthetic Peptide
DCSGSIRR

SEQ ID NO: 2324 - protein, 9 aa, Unknown
  Synthetic Peptide
DCSGSIRRH

SEQ ID NO: 2325 - protein, 11 aa, Unknown
  Synthetic Peptide
DDQPRPRGDNF

SEQ ID NO: 2326 - protein, 11 aa, Unknown
  Synthetic Peptide
DDREENFDIPK

SEQ ID NO: 2327 - protein, 8 aa, Unknown
  Synthetic Peptide
DGKCNLYA

SEQ ID NO: 2328 - protein, 11 aa, Unknown
  Synthetic Peptide
DGKCNLYADSA

SEQ ID NO: 2329 - protein, 9 aa, Unknown
  Synthetic Peptide
DIPKKPENK

SEQ ID NO: 2330 - protein, 10 aa, Unknown
  Synthetic Peptide
DIPKKPENKH

SEQ ID NO: 2331 - protein, 8 aa, Unknown
  Synthetic Peptide
DLDEPEQF

SEQ ID NO: 2332 - protein, 9 aa, Unknown
  Synthetic Peptide
DLDEPEQFR

SEQ ID NO: 2333 - protein, 8 aa, Unknown
  Synthetic Peptide
DLFLVNGR

SEQ ID NO: 2334 - protein, 8 aa, Unknown
  Synthetic Peptide
DSAWENVK

SEQ ID NO: 2335 - protein, 8 aa, Unknown
  Synthetic Peptide
DSIQDSLK

SEQ ID NO: 2336 - protein, 11 aa, Unknown
  Synthetic Peptide
DSIQDSLKESR

SEQ ID NO: 2337 - protein, 8 aa, Unknown
  Synthetic Peptide
DSLKESRK

SEQ ID NO: 2338 - protein, 10 aa, Unknown
  Synthetic Peptide
DVPKNPEDDR

SEQ ID NO: 2339 - protein, 11 aa, Unknown
  Synthetic Peptide
DVQNNIVDEIK

SEQ ID NO: 2340 - protein, 8 aa, Unknown
  Synthetic Peptide
EDDQPRPR

SEQ ID NO: 2341 - protein, 8 aa, Unknown
  Synthetic Peptide
EDDREENF

SEQ ID NO: 2342 - protein, 11 aa, Unknown
  Synthetic Peptide
EDKDLDEPEQF

SEQ ID NO: 2343 - protein, 8 aa, Unknown
  Synthetic Peptide
EDRETRPH

SEQ ID NO: 2344 - protein, 10 aa, Unknown
  Synthetic Peptide
EDRETRPHGR

SEQ ID NO: 2345 - protein, 9 aa, Unknown
  Synthetic Peptide
EIIRLHSDA

SEQ ID NO: 2346 - protein, 11 aa, Unknown
  Synthetic Peptide
EIIRLHSDASK

SEQ ID NO: 2347 - protein, 10 aa, Unknown
  Synthetic Peptide
ELQEQCEEER

SEQ ID NO: 2348 - protein, 8 aa, Unknown
  Synthetic Peptide
ETLGEEDK

SEQ ID NO: 2349 - protein, 10 aa, Unknown
  Synthetic Peptide
EVCNDEVDLY

SEQ ID NO: 2350 - protein, 8 aa, Unknown
  Synthetic Peptide
EVPSDVPK

SEQ ID NO: 2351 - protein, 10 aa, Unknown
  Synthetic Peptide
FDETLGEEDK

SEQ ID NO: 2352 - protein, 10 aa, Unknown
  Synthetic Peptide
FDIPKKPENK

SEQ ID NO: 2353 - protein, 11 aa, Unknown
  Synthetic Peptide
FDIPKKPENKH

SEQ ID NO: 2354 - protein, 9 aa, Unknown
  Synthetic Peptide
FDLFLVNGR

SEQ ID NO: 2355 - protein, 10 aa, Unknown
  Synthetic Peptide
FFDLFLVNGR

SEQ ID NO: 2356 - protein, 10 aa, Unknown
  Synthetic Peptide
FGIGQGINVA

SEQ ID NO: 2357 - protein, 11 aa, Unknown
  Synthetic Peptide
FGIGQGINVAF

SEQ ID NO: 2358 - protein, 8 aa, Unknown
  Synthetic Peptide
FLIFFDLF

SEQ ID NO: 2359 - protein, 11 aa, Unknown
  Synthetic Peptide
FLVGCHPSDGK

SEQ ID NO: 2360 - protein, 11 aa, Unknown
  Synthetic Peptide
FMKAVCVEVEK

SEQ ID NO: 2361 - protein, 10 aa, Unknown
  Synthetic Peptide
FVVPGAATPY

SEQ ID NO: 2362 - protein, 11 aa, Unknown
  Synthetic Peptide
FVVPGAATPYA

SEQ ID NO: 2363 - protein, 11 aa, Unknown
  Synthetic Peptide
GAATPYAGEPA

SEQ ID NO: 2364 - protein, 8 aa, Unknown
  Synthetic Peptide
GCHPSDGK

SEQ ID NO: 2365 - protein, 8 aa, Unknown
  Synthetic Peptide
GDNFAVEK

SEQ ID NO: 2366 - protein, 8 aa, Unknown
  Synthetic Peptide
GGIAGGLA

SEQ ID NO: 2367 - protein, 11 aa, Unknown
  Synthetic Peptide
GGIAGGLALLA

SEQ ID NO: 2368 - protein, 9 aa, Unknown
  Synthetic Peptide
GGLALLACA

SEQ ID NO: 2369 - protein, 10 aa, Unknown
  Synthetic Peptide
GIAGGLALLA

SEQ ID NO: 2370 - protein, 9 aa, Unknown
  Synthetic Peptide
GIGQGINVA

SEQ ID NO: 2371 - protein, 10 aa, Unknown
  Synthetic Peptide
GIGQGINVAF

SEQ ID NO: 2372 - protein, 8 aa, Unknown
  Synthetic Peptide
GINVAFNR

SEQ ID NO: 2373 - protein, 9 aa, Unknown
  Synthetic Peptide
GINVAFNRF

SEQ ID NO: 2374 - protein, 11 aa, Unknown
  Synthetic Peptide
GIPDSIQDSLK

SEQ ID NO: 2375 - protein, 8 aa, Unknown
  Synthetic Peptide
GLALLACA

SEQ ID NO: 2376 - protein, 11 aa, Unknown
  Synthetic Peptide
GLALLACAGLA

SEQ ID NO: 2377 - protein, 11 aa, Unknown
  Synthetic Peptide
GLAYKFVVPGA

SEQ ID NO: 2378 - protein, 11 aa, Unknown
  Synthetic Peptide
GSIRRHNWVNH

SEQ ID NO: 2379 - protein, 11 aa, Unknown
  Synthetic Peptide
GTRSRKREILH

SEQ ID NO: 2380 - protein, 8 aa, Unknown
  Synthetic Peptide
HAVPLAMK

SEQ ID NO: 2381 - protein, 11 aa, Unknown
  Synthetic Peptide
HDNQNNLPNDK

SEQ ID NO: 2382 - protein, 8 aa, Unknown
  Synthetic Peptide
HGRNNENR

SEQ ID NO: 2383 - protein, 10 aa, Unknown
  Synthetic Peptide
HGRNNENRSY

SEQ ID NO: 2384 - protein, 8 aa, Unknown
  Synthetic Peptide
HLNDRINR

SEQ ID NO: 2385 - protein, 11 aa, Unknown
  Synthetic Peptide
HLNDRINRENA

SEQ ID NO: 2386 - protein, 8 aa, Unknown
  Synthetic Peptide
HSDASKNK

SEQ ID NO: 2387 - protein, 10 aa, Unknown
  Synthetic Peptide
HSDASKNKEK

SEQ ID NO: 2388 - protein, 11 aa, Unknown
  Synthetic Peptide
HSDASKNKEKA

SEQ ID NO: 2389 - protein, 8 aa, Unknown
  Synthetic Peptide
HVPNSEDR

SEQ ID NO: 2390 - protein, 11 aa, Unknown
  Synthetic Peptide
HVPNSEDRETR

SEQ ID NO: 2391 - protein, 10 aa, Unknown
  Synthetic Peptide
IAGGIAGGLA

SEQ ID NO: 2392 - protein, 9 aa, Unknown
  Synthetic Peptide
IAGGLALLA

SEQ ID NO: 2393 - protein, 11 aa, Unknown
  Synthetic Peptide
IAGGLALLACA

SEQ ID NO: 2394 - protein, 11 aa, Unknown
  Synthetic Peptide
IFFDLFLVNGR

SEQ ID NO: 2395 - protein, 8 aa, Unknown
  Synthetic Peptide
IGQGINVA

SEQ ID NO: 2396 - protein, 9 aa, Unknown
  Synthetic Peptide
IGQGINVAF

SEQ ID NO: 2397 - protein, 11 aa, Unknown
  Synthetic Peptide
IGQGINVAFNR

SEQ ID NO: 2398 - protein, 8 aa, Unknown
  Synthetic Peptide
IIRLHSDA

SEQ ID NO: 2399 - protein, 10 aa, Unknown
  Synthetic Peptide
IIRLHSDASK

SEQ ID NO: 2400 - protein, 8 aa, Unknown
  Synthetic Peptide
IVDEIKYR

SEQ ID NO: 2401 - protein, 10 aa, Unknown
  Synthetic Peptide
IVFLIFFDLF

SEQ ID NO: 2402 - protein, 9 aa, Unknown
  Synthetic Peptide
KAVCVEVEK

SEQ ID NO: 2403 - protein, 11 aa, Unknown
  Synthetic Peptide
KAVCVEVEKTA

SEQ ID NO: 2404 - protein, 9 aa, Unknown
  Synthetic Peptide
KCNLYADSA

SEQ ID NO: 2405 - protein, 9 aa, Unknown
  Synthetic Peptide
KDLDEPEQF

SEQ ID NO: 2406 - protein, 10 aa, Unknown
  Synthetic Peptide
KDLDEPEQFR

SEQ ID NO: 2407 - protein, 8 aa, Unknown
  Synthetic Peptide
KFVVPGAA

SEQ ID NO: 2408 - protein, 11 aa, Unknown
  Synthetic Peptide
KFVVPGAATPY

SEQ ID NO: 2409 - protein, 8 aa, Unknown
  Synthetic Peptide
KGTRSRKR

SEQ ID NO: 2410 - protein, 11 aa, Unknown
  Synthetic Peptide
KIAGGIAGGLA

SEQ ID NO: 2411 - protein, 8 aa, Unknown
  Synthetic Peptide
KVLDNERK

SEQ ID NO: 2412 - protein, 8 aa, Unknown
  Synthetic Peptide
LACAGLAY

SEQ ID NO: 2413 - protein, 9 aa, Unknown
  Synthetic Peptide
LACAGLAYK

SEQ ID NO: 2414 - protein, 10 aa, Unknown
  Synthetic Peptide
LACAGLAYKF

SEQ ID NO: 2415 - protein, 10 aa, Unknown
  Synthetic Peptide
LALLACAGLA

SEQ ID NO: 2416 - protein, 11 aa, Unknown
  Synthetic Peptide
LALLACAGLAY

SEQ ID NO: 2417 - protein, 10 aa, Unknown
  Synthetic Peptide
LAYKFVVPGA

SEQ ID NO: 2418 - protein, 11 aa, Unknown
  Synthetic Peptide
LAYKFVVPGAA

SEQ ID NO: 2419 - protein, 8 aa, Unknown
  Synthetic Peptide
LDEPEQFR

SEQ ID NO: 2420 - protein, 11 aa, Unknown
  Synthetic Peptide
LGNVKYLVIVF

SEQ ID NO: 2421 - protein, 8 aa, Unknown
  Synthetic Peptide
LLACAGLA

SEQ ID NO: 2422 - protein, 9 aa, Unknown
  Synthetic Peptide
LLACAGLAY

SEQ ID NO: 2423 - protein, 10 aa, Unknown
  Synthetic Peptide
LLACAGLAYK

SEQ ID NO: 2424 - protein, 11 aa, Unknown
  Synthetic Peptide
LLACAGLAYKF

SEQ ID NO: 2425 - protein, 10 aa, Unknown
  Synthetic Peptide
LLMDCSGSIR

SEQ ID NO: 2426 - protein, 11 aa, Unknown
  Synthetic Peptide
LLMDCSGSIRR

SEQ ID NO: 2427 - protein, 11 aa, Unknown
  Synthetic Peptide
LLQVRKHLNDR

SEQ ID NO: 2428 - protein, 8 aa, Unknown
  Synthetic Peptide
LLSTNLPY

SEQ ID NO: 2429 - protein, 10 aa, Unknown
  Synthetic Peptide
LLSTNLPYGR

SEQ ID NO: 2430 - protein, 9 aa, Unknown
  Synthetic Peptide
LMDCSGSIR

SEQ ID NO: 2431 - protein, 10 aa, Unknown
  Synthetic Peptide
LMDCSGSIRR

SEQ ID NO: 2432 - protein, 11 aa, Unknown
  Synthetic Peptide
LMDCSGSIRRH

SEQ ID NO: 2433 - protein, 9 aa, Unknown
  Synthetic Peptide
LSTNLPYGR

SEQ ID NO: 2434 - protein, 10 aa, Unknown
  Synthetic Peptide
LVGCHPSDGK

SEQ ID NO: 2435 - protein, 8 aa, Unknown
  Synthetic Peptide
LVIVFLIF

SEQ ID NO: 2436 - protein, 9 aa, Unknown
  Synthetic Peptide
LVIVFLIFF

SEQ ID NO: 2437 - protein, 8 aa, Unknown
  Synthetic Peptide
MDCSGSIR

SEQ ID NO: 2438 - protein, 9 aa, Unknown
  Synthetic Peptide
MDCSGSIRR

SEQ ID NO: 2439 - protein, 10 aa, Unknown
  Synthetic Peptide
MDCSGSIRRH

SEQ ID NO: 2440 - protein, 9 aa, Unknown
  Synthetic Peptide
NDRINRENA

SEQ ID NO: 2441 - protein, 11 aa, Unknown
  Synthetic Peptide
NFDIPKKPENK

SEQ ID NO: 2442 - protein, 8 aa, Unknown
  Synthetic Peptide
NIPEDSEK

SEQ ID NO: 2443 - protein, 8 aa, Unknown
  Synthetic Peptide
NIVDEIKY

SEQ ID NO: 2444 - protein, 9 aa, Unknown
  Synthetic Peptide
NIVDEIKYR

SEQ ID NO: 2445 - protein, 9 aa, Unknown
  Synthetic Peptide
NLPNDKSDR

SEQ ID NO: 2446 - protein, 8 aa, Unknown
  Synthetic Peptide
NSEDRETR

SEQ ID NO: 2447 - protein, 10 aa, Unknown
  Synthetic Peptide
NSEDRETRPH

SEQ ID NO: 2448 - protein, 8 aa, Unknown
  Synthetic Peptide
NVIGPFMK

SEQ ID NO: 2449 - protein, 9 aa, Unknown
  Synthetic Peptide
NVIGPFMKA

SEQ ID NO: 2450 - protein, 9 aa, Unknown
  Synthetic Peptide
NVKNVIGPF

SEQ ID NO: 2451 - protein, 11 aa, Unknown
  Synthetic Peptide
NVKNVIGPFMK

SEQ ID NO: 2452 - protein, 9 aa, Unknown
  Synthetic Peptide
NVKYLVIVF

SEQ ID NO: 2453 - protein, 8 aa, Unknown
  Synthetic Peptide
PCSVTCGK

SEQ ID NO: 2454 - protein, 11 aa, Unknown
  Synthetic Peptide
PCSVTCGKGTR

SEQ ID NO: 2455 - protein, 9 aa, Unknown
  Synthetic Peptide
PDSIQDSLK

SEQ ID NO: 2456 - protein, 11 aa, Unknown
  Synthetic Peptide
PFDETLGEEDK

SEQ ID NO: 2457 - protein, 8 aa, Unknown
  Synthetic Peptide
PGAATPYA

SEQ ID NO: 2458 - protein, 9 aa, Unknown
  Synthetic Peptide
PSDGKCNLY

SEQ ID NO: 2459 - protein, 10 aa, Unknown
  Synthetic Peptide
PSDGKCNLYA

SEQ ID NO: 2460 - protein, 9 aa, Unknown
  Synthetic Peptide
PSPNPEEGK

SEQ ID NO: 2461 - protein, 10 aa, Unknown
  Synthetic Peptide
QCEEERCPPK

SEQ ID NO: 2462 - protein, 8 aa, Unknown
  Synthetic Peptide
QDNNGNRH

SEQ ID NO: 2463 - protein, 8 aa, Unknown
  Synthetic Peptide
QDSLKESR

SEQ ID NO: 2464 - protein, 9 aa, Unknown
  Synthetic Peptide
QDSLKESRK

SEQ ID NO: 2465 - protein, 9 aa, Unknown
  Synthetic Peptide
QGINVAFNR

SEQ ID NO: 2466 - protein, 10 aa, Unknown
  Synthetic Peptide
QGINVAFNRF

SEQ ID NO: 2467 - protein, 9 aa, Unknown
  Synthetic Peptide
QSQDNNGNR

SEQ ID NO: 2468 - protein, 10 aa, Unknown
  Synthetic Peptide
QSQDNNGNRH

SEQ ID NO: 2469 - protein, 9 aa, Unknown
  Synthetic Peptide
QVRKHLNDR

SEQ ID NO: 2470 - protein, 9 aa, Unknown
  Synthetic Peptide
RGDNFAVEK

SEQ ID NO: 2471 - protein, 8 aa, Unknown
  Synthetic Peptide
RGVKIAVF

SEQ ID NO: 2472 - protein, 8 aa, Unknown
  Synthetic Peptide
RLHSDASK

SEQ ID NO: 2473 - protein, 10 aa, Unknown
  Synthetic Peptide
RLHSDASKNK

SEQ ID NO: 2474 - protein, 9 aa, Unknown
  Synthetic Peptide
RSRKREILH

SEQ ID NO: 2475 - protein, 9 aa, Unknown
  Synthetic Peptide
SDASKNKEK

SEQ ID NO: 2476 - protein, 10 aa, Unknown
  Synthetic Peptide
SDASKNKEKA

SEQ ID NO: 2477 - protein, 8 aa, Unknown
  Synthetic Peptide
SDGKCNLY

SEQ ID NO: 2478 - protein, 9 aa, Unknown
  Synthetic Peptide
SDGKCNLYA

SEQ ID NO: 2479 - protein, 8 aa, Unknown
  Synthetic Peptide
SDNKYKIA

SEQ ID NO: 2480 - protein, 11 aa, Unknown
  Synthetic Peptide
SDVPKNPEDDR

SEQ ID NO: 2481 - protein, 10 aa, Unknown
  Synthetic Peptide
SIQDSLKESR

SEQ ID NO: 2482 - protein, 11 aa, Unknown
  Synthetic Peptide
SIQDSLKESRK

SEQ ID NO: 2483 - protein, 10 aa, Unknown
  Synthetic Peptide
SIRRHNWVNH

SEQ ID NO: 2484 - protein, 11 aa, Unknown
  Synthetic Peptide
SIRRHNWVNHA

SEQ ID NO: 2485 - protein, 9 aa, Unknown
  Synthetic Peptide
SLLSTNLPY

SEQ ID NO: 2486 - protein, 11 aa, Unknown
  Synthetic Peptide
SLLSTNLPYGR

SEQ ID NO: 2487 - protein, 8 aa, Unknown
  Synthetic Peptide
STNLPYGR

SEQ ID NO: 2488 - protein, 9 aa, Unknown
  Synthetic Peptide
SVTCGKGTR

SEQ ID NO: 2489 - protein, 11 aa, Unknown
  Synthetic Peptide
SVTCGKGTRSR

SEQ ID NO: 2490 - protein, 9 aa, Unknown
  Synthetic Peptide
TCGKGTRSR

SEQ ID NO: 2491 - protein, 10 aa, Unknown
  Synthetic Peptide
TCGKGTRSRK

SEQ ID NO: 2492 - protein, 11 aa, Unknown
  Synthetic Peptide
TCGKGTRSRKR

SEQ ID NO: 2493 - protein, 11 aa, Unknown
  Synthetic Peptide
VAFNRFLVGCH

SEQ ID NO: 2494 - protein, 9 aa, Unknown
  Synthetic Peptide
VCNDEVDLY

SEQ ID NO: 2495 - protein, 9 aa, Unknown
  Synthetic Peptide
VCVEVEKTA

SEQ ID NO: 2496 - protein, 11 aa, Unknown
  Synthetic Peptide
VFGIGQGINVA

SEQ ID NO: 2497 - protein, 9 aa, Unknown
  Synthetic Peptide
VFLIFFDLF

SEQ ID NO: 2498 - protein, 9 aa, Unknown
  Synthetic Peptide
VGCHPSDGK

SEQ ID NO: 2499 - protein, 8 aa, Unknown
  Synthetic Peptide
VIGPFMKA

SEQ ID NO: 2500 - protein, 8 aa, Unknown
  Synthetic Peptide
VIVFLIFF

SEQ ID NO: 2501 - protein, 11 aa, Unknown
  Synthetic Peptide
VIVFLIFFDLF

SEQ ID NO: 2502 - protein, 8 aa, Unknown
  Synthetic Peptide
VTCGKGTR

SEQ ID NO: 2503 - protein, 10 aa, Unknown
  Synthetic Peptide
VTCGKGTRSR

SEQ ID NO: 2504 - protein, 11 aa, Unknown
  Synthetic Peptide
VTCGKGTRSRK

SEQ ID NO: 2505 - protein, 9 aa, Unknown
  Synthetic Peptide
VVPGAATPY

SEQ ID NO: 2506 - protein, 10 aa, Unknown
  Synthetic Peptide
VVPGAATPYA

SEQ ID NO: 2507 - protein, 10 aa, Unknown
  Synthetic Peptide
WSPCSVTCGK

SEQ ID NO: 2508 - protein, 9 aa, Unknown
  Synthetic Peptide
WVNHAVPLA

SEQ ID NO: 2509 - protein, 11 aa, Unknown
  Synthetic Peptide
WVNHAVPLAMK

SEQ ID NO: 2510 - protein, 10 aa, Unknown
  Synthetic Peptide
YADSAWENVK

SEQ ID NO: 2511 - protein, 8 aa, Unknown
  Synthetic Peptide
YAGEPAPF

SEQ ID NO: 2512 - protein, 11 aa, Unknown
  Synthetic Peptide
YLLMDCSGSIR

SEQ ID NO: 2513 - protein, 9 aa, Unknown
  Synthetic Peptide
YLVIVFLIF

SEQ ID NO: 2514 - protein, 10 aa, Unknown
  Synthetic Peptide
YLVIVFLIFF

SEQ ID NO: 2515 - protein, 9 aa, Unknown
  Synthetic Peptide
ALFQEYQCY

SEQ ID NO: 2516 - protein, 8 aa, Unknown
  Synthetic Peptide
ANANNAVK

SEQ ID NO: 2517 - protein, 9 aa, Unknown
  Synthetic Peptide
ANPNANPNK

SEQ ID NO: 2518 - protein, 8 aa, Unknown
  Synthetic Peptide
CGNGIQVR

SEQ ID NO: 2519 - protein, 10 aa, Unknown
  Synthetic Peptide
CGNGIQVRIK

SEQ ID NO: 2520 - protein, 9 aa, Unknown
  Synthetic Peptide
DGNNEDNEK

SEQ ID NO: 2521 - protein, 11 aa, Unknown
  Synthetic Peptide
DGNNEDNEKLR

SEQ ID NO: 2522 - protein, 11 aa, Unknown
  Synthetic Peptide
DGNNNNGDNGR

SEQ ID NO: 2523 - protein, 8 aa, Unknown
  Synthetic Peptide
DIEKKICK

SEQ ID NO: 2524 - protein, 11 aa, Unknown
  Synthetic Peptide
DIEKKICKMEK

SEQ ID NO: 2525 - protein, 8 aa, Unknown
  Synthetic Peptide
DNAGINLY

SEQ ID NO: 2526 - protein, 9 aa, Unknown
  Synthetic Peptide
DNEKLRKPK

SEQ ID NO: 2527 - protein, 10 aa, Unknown
  Synthetic Peptide
DNEKLRKPKH

SEQ ID NO: 2528 - protein, 11 aa, Unknown
  Synthetic Peptide
DNEKLRKPKHK

SEQ ID NO: 2529 - protein, 11 aa, Unknown
  Synthetic Peptide
DNGREGKDEDK

SEQ ID NO: 2530 - protein, 10 aa, Unknown
  Synthetic Peptide
EALFQEYQCY

SEQ ID NO: 2531 - protein, 8 aa, Unknown
  Synthetic Peptide
EDNEKLRK

SEQ ID NO: 2532 - protein, 10 aa, Unknown
  Synthetic Peptide
EDNEKLRKPK

SEQ ID NO: 2533 - protein, 11 aa, Unknown
  Synthetic Peptide
EDNEKLRKPKH

SEQ ID NO: 2534 - protein, 8 aa, Unknown
  Synthetic Peptide
EGKDEDKR

SEQ ID NO: 2535 - protein, 9 aa, Unknown
  Synthetic Peptide
ELEMNYYGK

SEQ ID NO: 2536 - protein, 10 aa, Unknown
  Synthetic Peptide
ENANANNAVK

SEQ ID NO: 2537 - protein, 10 aa, Unknown
  Synthetic Peptide
ENDIEKKICK

SEQ ID NO: 2538 - protein, 8 aa, Unknown
  Synthetic Peptide
ENWYSLKK

SEQ ID NO: 2539 - protein, 11 aa, Unknown
  Synthetic Peptide
ENWYSLKKNSR

SEQ ID NO: 2540 - protein, 11 aa, Unknown
  Synthetic Peptide
FLFVEALFQEY

SEQ ID NO: 2541 - protein, 9 aa, Unknown
  Synthetic Peptide
FVEALFQEY

SEQ ID NO: 2542 - protein, 8 aa, Unknown
  Synthetic Peptide
GDNGREGK

SEQ ID NO: 2543 - protein, 9 aa, Unknown
  Synthetic Peptide
GNGIQVRIK

SEQ ID NO: 2544 - protein, 8 aa, Unknown
  Synthetic Peptide
GNNEDNEK

SEQ ID NO: 2545 - protein, 10 aa, Unknown
  Synthetic Peptide
GNNEDNEKLR

SEQ ID NO: 2546 - protein, 11 aa, Unknown
  Synthetic Peptide
GNNEDNEKLRK

SEQ ID NO: 2547 - protein, 10 aa, Unknown
  Synthetic Peptide
GNNNNGDNGR

SEQ ID NO: 2548 - protein, 8 aa, Unknown
  Synthetic Peptide
HIEQYLKK

SEQ ID NO: 2549 - protein, 9 aa, Unknown
  Synthetic Peptide
HNMPNDPNR

SEQ ID NO: 2550 - protein, 11 aa, Unknown
  Synthetic Peptide
INLYNELEMNY

SEQ ID NO: 2551 - protein, 8 aa, Unknown
  Synthetic Peptide
KLRKPKHK

SEQ ID NO: 2552 - protein, 9 aa, Unknown
  Synthetic Peptide
KLRKPKHKK

SEQ ID NO: 2553 - protein, 11 aa, Unknown
  Synthetic Peptide
KLRKPKHKKLK

SEQ ID NO: 2554 - protein, 11 aa, Unknown
  Synthetic Peptide
KNNNNEEPSDK

SEQ ID NO: 2555 - protein, 10 aa, Unknown
  Synthetic Peptide
KNNQGNGQGH

SEQ ID NO: 2556 - protein, 9 aa, Unknown
  Synthetic Peptide
LDYENDIEK

SEQ ID NO: 2557 - protein, 10 aa, Unknown
  Synthetic Peptide
LDYENDIEKK

SEQ ID NO: 2558 - protein, 8 aa, Unknown
  Synthetic Peptide
LFQEYQCY

SEQ ID NO: 2559 - protein, 10 aa, Unknown
  Synthetic Peptide
LFVEALFQEY

SEQ ID NO: 2560 - protein, 11 aa, Unknown
  Synthetic Peptide
LNYDNAGINLY

SEQ ID NO: 2561 - protein, 11 aa, Unknown
  Synthetic Peptide
MNYYGKQENWY

SEQ ID NO: 2562 - protein, 9 aa, Unknown
  Synthetic Peptide
NANANNAVK

SEQ ID NO: 2563 - protein, 10 aa, Unknown
  Synthetic Peptide
NANPNANPNK

SEQ ID NO: 2564 - protein, 9 aa, Unknown
  Synthetic Peptide
NDIEKKICK

SEQ ID NO: 2565 - protein, 9 aa, Unknown
  Synthetic Peptide
NGDNGREGK

SEQ ID NO: 2566 - protein, 8 aa, Unknown
  Synthetic Peptide
NGIQVRIK

SEQ ID NO: 2567 - protein, 10 aa, Unknown
  Synthetic Peptide
NGREGKDEDK

SEQ ID NO: 2568 - protein, 11 aa, Unknown
  Synthetic Peptide
NGREGKDEDKR

SEQ ID NO: 2569 - protein, 10 aa, Unknown
  Synthetic Peptide
NLYNELEMNY

SEQ ID NO: 2570 - protein, 11 aa, Unknown
  Synthetic Peptide
NLYNELEMNYY

SEQ ID NO: 2571 - protein, 8 aa, Unknown
  Synthetic Peptide
NMPNDPNR

SEQ ID NO: 2572 - protein, 9 aa, Unknown
  Synthetic Peptide
NNEDNEKLR

SEQ ID NO: 2573 - protein, 10 aa, Unknown
  Synthetic Peptide
NNEDNEKLRK

SEQ ID NO: 2574 - protein, 8 aa, Unknown
  Synthetic Peptide
NNEEPSDK

SEQ ID NO: 2575 - protein, 9 aa, Unknown
  Synthetic Peptide
NNEEPSDKH

SEQ ID NO: 2576 - protein, 10 aa, Unknown
  Synthetic Peptide
NNGDNGREGK

SEQ ID NO: 2577 - protein, 9 aa, Unknown
  Synthetic Peptide
NNNEEPSDK

SEQ ID NO: 2578 - protein, 10 aa, Unknown
  Synthetic Peptide
NNNEEPSDKH

SEQ ID NO: 2579 - protein, 8 aa, Unknown
  Synthetic Peptide
NNNGDNGR

SEQ ID NO: 2580 - protein, 11 aa, Unknown
  Synthetic Peptide
NNNGDNGREGK

SEQ ID NO: 2581 - protein, 10 aa, Unknown
  Synthetic Peptide
NNNNEEPSDK

SEQ ID NO: 2582 - protein, 11 aa, Unknown
  Synthetic Peptide
NNNNEEPSDKH

SEQ ID NO: 2583 - protein, 9 aa, Unknown
  Synthetic Peptide
NNNNGDNGR

SEQ ID NO: 2584 - protein, 9 aa, Unknown
  Synthetic Peptide
NNQGNGQGH

SEQ ID NO: 2585 - protein, 10 aa, Unknown
  Synthetic Peptide
NTRVLNELNY

SEQ ID NO: 2586 - protein, 11 aa, Unknown
  Synthetic Peptide
PNANPNANPNK

SEQ ID NO: 2587 - protein, 9 aa, Unknown
  Synthetic Peptide
PSDKHIEQY

SEQ ID NO: 2588 - protein, 11 aa, Unknown
  Synthetic Peptide
PSDKHIEQYLK

SEQ ID NO: 2589 - protein, 10 aa, Unknown
  Synthetic Peptide
QCYGSSSNTR

SEQ ID NO: 2590 - protein, 11 aa, Unknown
  Synthetic Peptide
QGHNMPNDPNR

SEQ ID NO: 2591 - protein, 10 aa, Unknown
  Synthetic Peptide
RDGNNEDNEK

SEQ ID NO: 2592 - protein, 8 aa, Unknown
  Synthetic Peptide
RVLNELNY

SEQ ID NO: 2593 - protein, 8 aa, Unknown
  Synthetic Peptide
SDKHIEQY

SEQ ID NO: 2594 - protein, 10 aa, Unknown
  Synthetic Peptide
SDKHIEQYLK

SEQ ID NO: 2595 - protein, 11 aa, Unknown
  Synthetic Peptide
SDKHIEQYLKK

SEQ ID NO: 2596 - protein, 11 aa, Unknown
  Synthetic Peptide
SNTRVLNELNY

SEQ ID NO: 2597 - protein, 11 aa, Unknown
  Synthetic Peptide
SVTCGNGIQVR

SEQ ID NO: 2598 - protein, 9 aa, Unknown
  Synthetic Peptide
TCGNGIQVR

SEQ ID NO: 2599 - protein, 11 aa, Unknown
  Synthetic Peptide
TCGNGIQVRIK

SEQ ID NO: 2600 - protein, 10 aa, Unknown
  Synthetic Peptide
VTCGNGIQVR

SEQ ID NO: 2601 - protein, 9 aa, Unknown
  Synthetic Peptide
YDNAGINLY

SEQ ID NO: 2602 - protein, 8 aa, Unknown
  Synthetic Peptide
YGKQENWY

SEQ ID NO: 2603 - protein, 11 aa, Unknown
  Synthetic Peptide
YGKQENWYSLK

SEQ ID NO: 2604 - protein, 8 aa, Unknown
  Synthetic Peptide
YGSSSNTR

SEQ ID NO: 2605 - protein, 8 aa, Unknown
  Synthetic Peptide
YNELEMNY

SEQ ID NO: 2606 - protein, 9 aa, Unknown
  Synthetic Peptide
YNELEMNYY

SEQ ID NO: 2607 - protein, 11 aa, Unknown
  Synthetic Peptide
YNELEMNYYGK

SEQ ID NO: 2608 - protein, 8 aa, Unknown
  Synthetic Peptide
YSLKKNSR

SEQ ID NO: 2609 - protein, 9 aa, Unknown
  Synthetic Peptide
ALFFIIFNK

SEQ ID NO: 2610 - protein, 11 aa, Unknown
  Synthetic Peptide
DDNNLVSGPEH

SEQ ID NO: 2611 - protein, 8 aa, Unknown
  Synthetic Peptide
DLISDMIK

SEQ ID NO: 2612 - protein, 9 aa, Unknown
  Synthetic Peptide
DLISDMIKK

SEQ ID NO: 2613 - protein, 10 aa, Unknown
  Synthetic Peptide
DNNLVSGPEH

SEQ ID NO: 2614 - protein, 11 aa, Unknown
  Synthetic Peptide
DVHDLISDMIK

SEQ ID NO: 2615 - protein, 8 aa, Unknown
  Synthetic Peptide
ELVEVNKR

SEQ ID NO: 2616 - protein, 9 aa, Unknown
  Synthetic Peptide
ELVEVNKRK

SEQ ID NO: 2617 - protein, 11 aa, Unknown
  Synthetic Peptide
ELVEVNKRKSK

SEQ ID NO: 2618 - protein, 9 aa, Unknown
  Synthetic Peptide
ESLAEKTNK

SEQ ID NO: 2619 - protein, 8 aa, Unknown
  Synthetic Peptide
EVNKRKSK

SEQ ID NO: 2620 - protein, 9 aa, Unknown
  Synthetic Peptide
EVNKRKSKY

SEQ ID NO: 2621 - protein, 10 aa, Unknown
  Synthetic Peptide
EVNKRKSKYK

SEQ ID NO: 2622 - protein, 11 aa, Unknown
  Synthetic Peptide
FLALFFIIFNK

SEQ ID NO: 2623 - protein, 9 aa, Unknown
  Synthetic Peptide
FNKESLAEK

SEQ ID NO: 2624 - protein, 8 aa, Unknown
  Synthetic Peptide
GGVGLVLY

SEQ ID NO: 2625 - protein, 9 aa, Unknown
  Synthetic Peptide
GLVLYNTEK

SEQ ID NO: 2626 - protein, 11 aa, Unknown
  Synthetic Peptide
GLVLYNTEKGR

SEQ ID NO: 2627 - protein, 10 aa, Unknown
  Synthetic Peptide
GSGEPLIDVH

SEQ ID NO: 2628 - protein, 8 aa, Unknown
  Synthetic Peptide
GSGVSSKK

SEQ ID NO: 2629 - protein, 9 aa, Unknown
  Synthetic Peptide
GSGVSSKKK

SEQ ID NO: 2630 - protein, 11 aa, Unknown
  Synthetic Peptide
GSGVSSKKKNK

SEQ ID NO: 2631 - protein, 9 aa, Unknown
  Synthetic Peptide
GTGSGVSSK

SEQ ID NO: 2632 - protein, 10 aa, Unknown
  Synthetic Peptide
GTGSGVSSKK

SEQ ID NO: 2633 - protein, 11 aa, Unknown
  Synthetic Peptide
GTGSGVSSKKK

SEQ ID NO: 2634 - protein, 11 aa, Unknown
  Synthetic Peptide
GVGLVLYNTEK

SEQ ID NO: 2635 - protein, 9 aa, Unknown
  Synthetic Peptide
GVSSKKKNK

SEQ ID NO: 2636 - protein, 10 aa, Unknown
  Synthetic Peptide
GVSSKKKNKK

SEQ ID NO: 2637 - protein, 9 aa, Unknown
  Synthetic Peptide
HDLISDMIK

SEQ ID NO: 2638 - protein, 10 aa, Unknown
  Synthetic Peptide
HDLISDMIKK

SEQ ID NO: 2639 - protein, 10 aa, Unknown
  Synthetic Peptide
IFNKESLAEK

SEQ ID NO: 2640 - protein, 11 aa, Unknown
  Synthetic Peptide
IIFNKESLAEK

SEQ ID NO: 2641 - protein, 11 aa, Unknown
  Synthetic Peptide
KGSGEPLIDVH

SEQ ID NO: 2642 - protein, 10 aa, Unknown
  Synthetic Peptide
KGTGSGVSSK

SEQ ID NO: 2643 - protein, 11 aa, Unknown
  Synthetic Peptide
KGTGSGVSSKK

SEQ ID NO: 2644 - protein, 10 aa, Unknown
  Synthetic Peptide
LALFFIIFNK

SEQ ID NO: 2645 - protein, 8 aa, Unknown
  Synthetic Peptide
LFFIIFNK

SEQ ID NO: 2646 - protein, 9 aa, Unknown
  Synthetic Peptide
LGGVGLVLY

SEQ ID NO: 2647 - protein, 8 aa, Unknown
  Synthetic Peptide
LISDMIKK

SEQ ID NO: 2648 - protein, 10 aa, Unknown
  Synthetic Peptide
LLGGVGLVLY

SEQ ID NO: 2649 - protein, 8 aa, Unknown
  Synthetic Peptide
LVEVNKRK

SEQ ID NO: 2650 - protein, 10 aa, Unknown
  Synthetic Peptide
LVEVNKRKSK

SEQ ID NO: 2651 - protein, 11 aa, Unknown
  Synthetic Peptide
LVEVNKRKSKY

SEQ ID NO: 2652 - protein, 8 aa, Unknown
  Synthetic Peptide
LVLYNTEK

SEQ ID NO: 2653 - protein, 10 aa, Unknown
  Synthetic Peptide
LVLYNTEKGR

SEQ ID NO: 2654 - protein, 11 aa, Unknown
  Synthetic Peptide
LVLYNTEKGRH

SEQ ID NO: 2655 - protein, 8 aa, Unknown
  Synthetic Peptide
NLVSGPEH

SEQ ID NO: 2656 - protein, 9 aa, Unknown
  Synthetic Peptide
NNLVSGPEH

SEQ ID NO: 2657 - protein, 10 aa, Unknown
  Synthetic Peptide
NTEKGRHPFK

SEQ ID NO: 2658 - protein, 9 aa, Unknown
  Synthetic Peptide
SGEPLIDVH

SEQ ID NO: 2659 - protein, 8 aa, Unknown
  Synthetic Peptide
SGVSSKKK

SEQ ID NO: 2660 - protein, 10 aa, Unknown
  Synthetic Peptide
SGVSSKKKNK

SEQ ID NO: 2661 - protein, 11 aa, Unknown
  Synthetic Peptide
SGVSSKKKNKK

SEQ ID NO: 2662 - protein, 8 aa, Unknown
  Synthetic Peptide
SLAEKTNK

SEQ ID NO: 2663 - protein, 8 aa, Unknown
  Synthetic Peptide
SSKKKNKK

SEQ ID NO: 2664 - protein, 8 aa, Unknown
  Synthetic Peptide
TGSGVSSK

SEQ ID NO: 2665 - protein, 9 aa, Unknown
  Synthetic Peptide
TGSGVSSKK

SEQ ID NO: 2666 - protein, 10 aa, Unknown
  Synthetic Peptide
TGSGVSSKKK

SEQ ID NO: 2667 - protein, 10 aa, Unknown
  Synthetic Peptide
VGLVLYNTEK

SEQ ID NO: 2668 - protein, 11 aa, Unknown
  Synthetic Peptide
VLLGGVGLVLY

SEQ ID NO: 2669 - protein, 9 aa, Unknown
  Synthetic Peptide
VLYNTEKGR

SEQ ID NO: 2670 - protein, 10 aa, Unknown
  Synthetic Peptide
VLYNTEKGRH

SEQ ID NO: 2671 - protein, 8 aa, Unknown
  Synthetic Peptide
VNKRKSKY

SEQ ID NO: 2672 - protein, 9 aa, Unknown
  Synthetic Peptide
VNKRKSKYK

SEQ ID NO: 2673 - protein, 8 aa, Unknown
  Synthetic Peptide
VSSKKKNK

SEQ ID NO: 2674 - protein, 9 aa, Unknown
  Synthetic Peptide
VSSKKKNKK

SEQ ID NO: 2675 - protein, 8 aa, Unknown
  Synthetic Peptide
YNTEKGRH

SEQ ID NO: 2676 - protein, 11 aa, Unknown
  Synthetic Peptide
YNTEKGRHPFK

SEQ ID NO: 2677 - protein, 9 aa, Unknown
  Synthetic Peptide
ADTKKNLER

SEQ ID NO: 2678 - protein, 10 aa, Unknown
  Synthetic Peptide
ADTKKNLERK

SEQ ID NO: 2679 - protein, 11 aa, Unknown
  Synthetic Peptide
ADTKKNLERKK

SEQ ID NO: 2680 - protein, 10 aa, Unknown
  Synthetic Peptide
AIELPSENER

SEQ ID NO: 2681 - protein, 10 aa, Unknown
  Synthetic Peptide
ANEKLQEQQR

SEQ ID NO: 2682 - protein, 8 aa, Unknown
  Synthetic Peptide
DDDDKKKY

SEQ ID NO: 2683 - protein, 10 aa, Unknown
  Synthetic Peptide
DDDDKKKYIK

SEQ ID NO: 2684 - protein, 9 aa, Unknown
  Synthetic Peptide
DDDKKKYIK

SEQ ID NO: 2685 - protein, 9 aa, Unknown
  Synthetic Peptide
DDEDLDEFK

SEQ ID NO: 2686 - protein, 8 aa, Unknown
  Synthetic Peptide
DDKKKYIK

SEQ ID NO: 2687 - protein, 9 aa, Unknown
  Synthetic Peptide
DDLDEGIEK

SEQ ID NO: 2688 - protein, 9 aa, Unknown
  Synthetic Peptide
DGSIKPEQK

SEQ ID NO: 2689 - protein, 10 aa, Unknown
  Synthetic Peptide
DIHKGHLEEK

SEQ ID NO: 2690 - protein, 11 aa, Unknown
  Synthetic Peptide
DIHKGHLEEKK

SEQ ID NO: 2691 - protein, 8 aa, Unknown
  Synthetic Peptide
DITKYFMK

SEQ ID NO: 2692 - protein, 11 aa, Unknown
  Synthetic Peptide
DLDEFKPIVQY

SEQ ID NO: 2693 - protein, 8 aa, Unknown
  Synthetic Peptide
DLDEGIEK

SEQ ID NO: 2694 - protein, 8 aa, Unknown
  Synthetic Peptide
DLEEKAAK

SEQ ID NO: 2695 - protein, 9 aa, Unknown
  Synthetic Peptide
DLEQDRLAK

SEQ ID NO: 2696 - protein, 11 aa, Unknown
  Synthetic Peptide
DLEQDRLAKEK

SEQ ID NO: 2697 - protein, 9 aa, Unknown
  Synthetic Peptide
DLEQERLAK

SEQ ID NO: 2698 - protein, 11 aa, Unknown
  Synthetic Peptide
DLEQERLAKEK

SEQ ID NO: 2699 - protein, 11 aa, Unknown
  Synthetic Peptide
DLEQERLANEK

SEQ ID NO: 2700 - protein, 9 aa, Unknown
  Synthetic Peptide
DLEQERRAK

SEQ ID NO: 2701 - protein, 11 aa, Unknown
  Synthetic Peptide
DLEQERRAKEK

SEQ ID NO: 2702 - protein, 10 aa, Unknown
  Synthetic Peptide
DLEQRKADTK

SEQ ID NO: 2703 - protein, 11 aa, Unknown
  Synthetic Peptide
DLEQRKADTKK

SEQ ID NO: 2704 - protein, 9 aa, Unknown
  Synthetic Peptide
DLERTKASK

SEQ ID NO: 2705 - protein, 9 aa, Unknown
  Synthetic Peptide
DNNFKPNDK

SEQ ID NO: 2706 - protein, 10 aa, Unknown
  Synthetic Peptide
DNRGNSRDSK

SEQ ID NO: 2707 - protein, 9 aa, Unknown
  Synthetic Peptide
DSEQERLAK

SEQ ID NO: 2708 - protein, 11 aa, Unknown
  Synthetic Peptide
DSEQERLAKEK

SEQ ID NO: 2709 - protein, 10 aa, Unknown
  Synthetic Peptide
DSKEISIIEK

SEQ ID NO: 2710 - protein, 8 aa, Unknown
  Synthetic Peptide
DTKKNLER

SEQ ID NO: 2711 - protein, 9 aa, Unknown
  Synthetic Peptide
DTKKNLERK

SEQ ID NO: 2712 - protein, 10 aa, Unknown
  Synthetic Peptide
DTKKNLERKK

SEQ ID NO: 2713 - protein, 8 aa, Unknown
  Synthetic Peptide
DVLAEDLY

SEQ ID NO: 2714 - protein, 10 aa, Unknown
  Synthetic Peptide
DVLAEDLYGR

SEQ ID NO: 2715 - protein, 9 aa, Unknown
  Synthetic Peptide
DVNDFQISK

SEQ ID NO: 2716 - protein, 10 aa, Unknown
  Synthetic Peptide
DVNDFQISKY

SEQ ID NO: 2717 - protein, 10 aa, Unknown
  Synthetic Peptide
EDDEDLDEFK

SEQ ID NO: 2718 - protein, 8 aa, Unknown
  Synthetic Peptide
EDEISAEY

SEQ ID NO: 2719 - protein, 9 aa, Unknown
  Synthetic Peptide
EDITKYFMK

SEQ ID NO: 2720 - protein, 10 aa, Unknown
  Synthetic Peptide
EDKSADIQNH

SEQ ID NO: 2721 - protein, 9 aa, Unknown
  Synthetic Peptide
EDLEEKAAK

SEQ ID NO: 2722 - protein, 8 aa, Unknown
  Synthetic Peptide
EFKPIVQY

SEQ ID NO: 2723 - protein, 8 aa, Unknown
  Synthetic Peptide
EGRRDIHK

SEQ ID NO: 2724 - protein, 10 aa, Unknown
  Synthetic Peptide
EGRRDIHKGH

SEQ ID NO: 2725 - protein, 8 aa, Unknown
  Synthetic Peptide
EIIKSNLR

SEQ ID NO: 2726 - protein, 10 aa, Unknown
  Synthetic Peptide
EISIIEKTNR

SEQ ID NO: 2727 - protein, 8 aa, Unknown
  Synthetic Peptide
ELEDLIEK

SEQ ID NO: 2728 - protein, 8 aa, Unknown
  Synthetic Peptide
ELPSENER

SEQ ID NO: 2729 - protein, 10 aa, Unknown
  Synthetic Peptide
ELPSENERGY

SEQ ID NO: 2730 - protein, 11 aa, Unknown
  Synthetic Peptide
ELPSENERGYY

SEQ ID NO: 2731 - protein, 8 aa, Unknown
  Synthetic Peptide
ELSEDITK

SEQ ID NO: 2732 - protein, 9 aa, Unknown
  Synthetic Peptide
ELSEDITKY

SEQ ID NO: 2733 - protein, 8 aa, Unknown
  Synthetic Peptide
ELSEEKIK

SEQ ID NO: 2734 - protein, 9 aa, Unknown
  Synthetic Peptide
ELSEEKIKK

SEQ ID NO: 2735 - protein, 11 aa, Unknown
  Synthetic Peptide
ELSEEKIKKGK

SEQ ID NO: 2736 - protein, 8 aa, Unknown
  Synthetic Peptide
ELTMSNVK

SEQ ID NO: 2737 - protein, 10 aa, Unknown
  Synthetic Peptide
ENERGYYIPH

SEQ ID NO: 2738 - protein, 9 aa, Unknown
  Synthetic Peptide
ENIFLKENK

SEQ ID NO: 2739 - protein, 9 aa, Unknown
  Synthetic Peptide
ENKLNKEGK

SEQ ID NO: 2740 - protein, 8 aa, Unknown
  Synthetic Peptide
ENNKFFDK

SEQ ID NO: 2741 - protein, 10 aa, Unknown
  Synthetic Peptide
ENNKFFDKDK

SEQ ID NO: 2742 - protein, 10 aa, Unknown
  Synthetic Peptide
ENRQEDLEEK

SEQ ID NO: 2743 - protein, 10 aa, Unknown
  Synthetic Peptide
ESITTNVEGR

SEQ ID NO: 2744 - protein, 11 aa, Unknown
  Synthetic Peptide
ESITTNVEGRR

SEQ ID NO: 2745 - protein, 10 aa, Unknown
  Synthetic Peptide
FILVNLLIFH

SEQ ID NO: 2746 - protein, 9 aa, Unknown
  Synthetic Peptide
FLKENKLNK

SEQ ID NO: 2747 - protein, 9 aa, Unknown
  Synthetic Peptide
GDVLAEDLY

SEQ ID NO: 2748 - protein, 11 aa, Unknown
  Synthetic Peptide
GDVLAEDLYGR

SEQ ID NO: 2749 - protein, 8 aa, Unknown
  Synthetic Peptide
GSIKPEQK

SEQ ID NO: 2750 - protein, 11 aa, Unknown
  Synthetic Peptide
GSIKPEQKEDK

SEQ ID NO: 2751 - protein, 8 aa, Unknown
  Synthetic Peptide
GSSNSRNR

SEQ ID NO: 2752 - protein, 9 aa, Unknown
  Synthetic Peptide
GVSENIFLK

SEQ ID NO: 2753 - protein, 10 aa, Unknown
  Synthetic Peptide
HGDVLAEDLY

SEQ ID NO: 2754 - protein, 9 aa, Unknown
  Synthetic Peptide
HIINDDDDK

SEQ ID NO: 2755 - protein, 10 aa, Unknown
  Synthetic Peptide
HIINDDDDKK

SEQ ID NO: 2756 - protein, 11 aa, Unknown
  Synthetic Peptide
HIINDDDDKKK

SEQ ID NO: 2757 - protein, 9 aa, Unknown
  Synthetic Peptide
HIKKYKNDK

SEQ ID NO: 2758 - protein, 8 aa, Unknown
  Synthetic Peptide
HILYISFY

SEQ ID NO: 2759 - protein, 8 aa, Unknown
  Synthetic Peptide
HINGKIIK

SEQ ID NO: 2760 - protein, 11 aa, Unknown
  Synthetic Peptide
HLEEKKDGSIK

SEQ ID NO: 2761 - protein, 8 aa, Unknown
  Synthetic Peptide
HNSYEKTK

SEQ ID NO: 2762 - protein, 8 aa, Unknown
  Synthetic Peptide
HVLSHNSY

SEQ ID NO: 2763 - protein, 10 aa, Unknown
  Synthetic Peptide
HVLSHNSYEK

SEQ ID NO: 2764 - protein, 10 aa, Unknown
  Synthetic Peptide
IFHINGKIIK

SEQ ID NO: 2765 - protein, 10 aa, Unknown
  Synthetic Peptide
IFLKENKLNK

SEQ ID NO: 2766 - protein, 8 aa, Unknown
  Synthetic Peptide
IINDDDDK

SEQ ID NO: 2767 - protein, 9 aa, Unknown
  Synthetic Peptide
IINDDDDKK

SEQ ID NO: 2768 - protein, 10 aa, Unknown
  Synthetic Peptide
IINDDDDKKK

SEQ ID NO: 2769 - protein, 11 aa, Unknown
  Synthetic Peptide
IINDDDDKKKY

SEQ ID NO: 2770 - protein, 9 aa, Unknown
  Synthetic Peptide
ILVNLLIFH

SEQ ID NO: 2771 - protein, 8 aa, Unknown
  Synthetic Peptide
INDDDDKK

SEQ ID NO: 2772 - protein, 9 aa, Unknown
  Synthetic Peptide
INDDDDKKK

SEQ ID NO: 2773 - protein, 10 aa, Unknown
  Synthetic Peptide
INDDDDKKKY

SEQ ID NO: 2774 - protein, 8 aa, Unknown
  Synthetic Peptide
INEEKHEK

SEQ ID NO: 2775 - protein, 9 aa, Unknown
  Synthetic Peptide
INEEKHEKK

SEQ ID NO: 2776 - protein, 10 aa, Unknown
  Synthetic Peptide
INEEKHEKKH

SEQ ID NO: 2777 - protein, 11 aa, Unknown
  Synthetic Peptide
INGKIIKNSEK

SEQ ID NO: 2778 - protein, 11 aa, Unknown
  Synthetic Peptide
ISDVNDFQISK

SEQ ID NO: 2779 - protein, 9 aa, Unknown
  Synthetic Peptide
ISIIEKTNR

SEQ ID NO: 2780 - protein, 8 aa, Unknown
  Synthetic Peptide
ITTNVEGR

SEQ ID NO: 2781 - protein, 9 aa, Unknown
  Synthetic Peptide
ITTNVEGRR

SEQ ID NO: 2782 - protein, 11 aa, Unknown
  Synthetic Peptide
IVDELSEDITK

SEQ ID NO: 2783 - protein, 10 aa, Unknown
  Synthetic Peptide
KADTKKNLER

SEQ ID NO: 2784 - protein, 11 aa, Unknown
  Synthetic Peptide
KADTKKNLERK

SEQ ID NO: 2785 - protein, 10 aa, Unknown
  Synthetic Peptide
KDEIIKSNLR

SEQ ID NO: 2786 - protein, 10 aa, Unknown
  Synthetic Peptide
KDGSIKPEQK

SEQ ID NO: 2787 - protein, 11 aa, Unknown
  Synthetic Peptide
KDKELTMSNVK

SEQ ID NO: 2788 - protein, 10 aa, Unknown
  Synthetic Peptide
KDNNFKPNDK

SEQ ID NO: 2789 - protein, 8 aa, Unknown
  Synthetic Peptide
KFIKSLFH

SEQ ID NO: 2790 - protein, 8 aa, Unknown
  Synthetic Peptide
KGHLEEKK

SEQ ID NO: 2791 - protein, 9 aa, Unknown
  Synthetic Peptide
KGKKYEKTK

SEQ ID NO: 2792 - protein, 8 aa, Unknown
  Synthetic Peptide
KIIKNSEK

SEQ ID NO: 2793 - protein, 8 aa, Unknown
  Synthetic Peptide
KIKKGKKY

SEQ ID NO: 2794 - protein, 10 aa, Unknown
  Synthetic Peptide
KIKKGKKYEK

SEQ ID NO: 2795 - protein, 11 aa, Unknown
  Synthetic Peptide
KLNKEGKLIEH

SEQ ID NO: 2796 - protein, 11 aa, Unknown
  Synthetic Peptide
KLQEQQSDLER

SEQ ID NO: 2797 - protein, 8 aa, Unknown
  Synthetic Peptide
KNDKQVNK

SEQ ID NO: 2798 - protein, 10 aa, Unknown
  Synthetic Peptide
KNDKQVNKEK

SEQ ID NO: 2799 - protein, 9 aa, Unknown
  Synthetic Peptide
KNLERKKEH

SEQ ID NO: 2800 - protein, 11 aa, Unknown
  Synthetic Peptide
KNNENNKFFDK

SEQ ID NO: 2801 - protein, 10 aa, Unknown
  Synthetic Peptide
KNSEKDEIIK

SEQ ID NO: 2802 - protein, 9 aa, Unknown
  Synthetic Peptide
KNVSQTNFK

SEQ ID NO: 2803 - protein, 8 aa, Unknown
  Synthetic Peptide
KSADIQNH

SEQ ID NO: 2804 - protein, 9 aa, Unknown
  Synthetic Peptide
KSLYDEHIK

SEQ ID NO: 2805 - protein, 10 aa, Unknown
  Synthetic Peptide
KSLYDEHIKK

SEQ ID NO: 2806 - protein, 11 aa, Unknown
  Synthetic Peptide
KSLYDEHIKKY

SEQ ID NO: 2807 - protein, 10 aa, Unknown
  Synthetic Peptide
KSSEELSEEK

SEQ ID NO: 2808 - protein, 8 aa, Unknown
  Synthetic Peptide
KTKDNNFK

SEQ ID NO: 2809 - protein, 9 aa, Unknown
  Synthetic Peptide
KTKNNENNK

SEQ ID NO: 2810 - protein, 8 aa, Unknown
  Synthetic Peptide
LAEDLYGR

SEQ ID NO: 2811 - protein, 11 aa, Unknown
  Synthetic Peptide
LAKEKLQEQQR

SEQ ID NO: 2812 - protein, 11 aa, Unknown
  Synthetic Peptide
LANEKLQEQQR

SEQ ID NO: 2813 - protein, 10 aa, Unknown
  Synthetic Peptide
LDDLDEGIEK

SEQ ID NO: 2814 - protein, 10 aa, Unknown
  Synthetic Peptide
LDEFKPIVQY

SEQ ID NO: 2815 - protein, 10 aa, Unknown
  Synthetic Peptide
LGVSENIFLK

SEQ ID NO: 2816 - protein, 8 aa, Unknown
  Synthetic Peptide
LIFHINGK

SEQ ID NO: 2817 - protein, 11 aa, Unknown
  Synthetic Peptide
LIFHINGKIIK

SEQ ID NO: 2818 - protein, 9 aa, Unknown
  Synthetic Peptide
LLIFHINGK

SEQ ID NO: 2819 - protein, 10 aa, Unknown
  Synthetic Peptide
LNKEGKLIEH

SEQ ID NO: 2820 - protein, 8 aa, Unknown
  Synthetic Peptide
LSEDITKY

SEQ ID NO: 2821 - protein, 11 aa, Unknown
  Synthetic Peptide
LSEDITKYFMK

SEQ ID NO: 2822 - protein, 8 aa, Unknown
  Synthetic Peptide
LSEEKIKK

SEQ ID NO: 2823 - protein, 10 aa, Unknown
  Synthetic Peptide
LSEEKIKKGK

SEQ ID NO: 2824 - protein, 11 aa, Unknown
  Synthetic Peptide
LSEEKIKKGKK

SEQ ID NO: 2825 - protein, 8 aa, Unknown
  Synthetic Peptide
LSHNSYEK

SEQ ID NO: 2826 - protein, 10 aa, Unknown
  Synthetic Peptide
LSHNSYEKTK

SEQ ID NO: 2827 - protein, 8 aa, Unknown
  Synthetic Peptide
LVNLLIFH

SEQ ID NO: 2828 - protein, 8 aa, Unknown
  Synthetic Peptide
NDDDDKKK

SEQ ID NO: 2829 - protein, 9 aa, Unknown
  Synthetic Peptide
NDDDDKKKY

SEQ ID NO: 2830 - protein, 11 aa, Unknown
  Synthetic Peptide
NDDDDKKKYIK

SEQ ID NO: 2831 - protein, 8 aa, Unknown
  Synthetic Peptide
NDFQISKY

SEQ ID NO: 2832 - protein, 9 aa, Unknown
  Synthetic Peptide
NDKQVNKEK

SEQ ID NO: 2833 - protein, 11 aa, Unknown
  Synthetic Peptide
NDKQVNKEKEK

SEQ ID NO: 2834 - protein, 9 aa, Unknown
  Synthetic Peptide
NDKSLYDEH

SEQ ID NO: 2835 - protein, 11 aa, Unknown
  Synthetic Peptide
NDKSLYDEHIK

SEQ ID NO: 2836 - protein, 10 aa, Unknown
  Synthetic Peptide
NFKPNDKSLY

SEQ ID NO: 2837 - protein, 11 aa, Unknown
  Synthetic Peptide
NFQDEENIGIY

SEQ ID NO: 2838 - protein, 10 aa, Unknown
  Synthetic Peptide
NGKIIKNSEK

SEQ ID NO: 2839 - protein, 8 aa, Unknown
  Synthetic Peptide
NIFLKENK

SEQ ID NO: 2840 - protein, 11 aa, Unknown
  Synthetic Peptide
NIFLKENKLNK

SEQ ID NO: 2841 - protein, 11 aa, Unknown
  Synthetic Peptide
NLDDLDEGIEK

SEQ ID NO: 2842 - protein, 8 aa, Unknown
  Synthetic Peptide
NLERKKEH

SEQ ID NO: 2843 - protein, 11 aa, Unknown
  Synthetic Peptide
NLGVSENIFLK

SEQ ID NO: 2844 - protein, 10 aa, Unknown
  Synthetic Peptide
NLLIFHINGK

SEQ ID NO: 2845 - protein, 10 aa, Unknown
  Synthetic Peptide
NLRSGSSNSR

SEQ ID NO: 2846 - protein, 10 aa, Unknown
  Synthetic Peptide
NNENNKFFDK

SEQ ID NO: 2847 - protein, 8 aa, Unknown
  Synthetic Peptide
NNFKPNDK

SEQ ID NO: 2848 - protein, 11 aa, Unknown
  Synthetic Peptide
NNFKPNDKSLY

SEQ ID NO: 2849 - protein, 9 aa, Unknown
  Synthetic Peptide
NNKFFDKDK

SEQ ID NO: 2850 - protein, 9 aa, Unknown
  Synthetic Peptide
NSEKDEIIK

SEQ ID NO: 2851 - protein, 10 aa, Unknown
  Synthetic Peptide
NSRNRINEEK

SEQ ID NO: 2852 - protein, 11 aa, Unknown
  Synthetic Peptide
NSRNRINEEKH

SEQ ID NO: 2853 - protein, 9 aa, Unknown
  Synthetic Peptide
NVEGRRDIH

SEQ ID NO: 2854 - protein, 10 aa, Unknown
  Synthetic Peptide
NVEGRRDIHK

SEQ ID NO: 2855 - protein, 11 aa, Unknown
  Synthetic Peptide
NVKNVSQTNFK

SEQ ID NO: 2856 - protein, 8 aa, Unknown
  Synthetic Peptide
NVSQTNFK

SEQ ID NO: 2857 - protein, 11 aa, Unknown
  Synthetic Peptide
PAIELPSENER

SEQ ID NO: 2858 - protein, 10 aa, Unknown
  Synthetic Peptide
PNDKSLYDEH

SEQ ID NO: 2859 - protein, 8 aa, Unknown
  Synthetic Peptide
PSENERGY

SEQ ID NO: 2860 - protein, 9 aa, Unknown
  Synthetic Peptide
PSENERGYY

SEQ ID NO: 2861 - protein, 9 aa, Unknown
  Synthetic Peptide
QDEENIGIY

SEQ ID NO: 2862 - protein, 10 aa, Unknown
  Synthetic Peptide
QDEENIGIYK

SEQ ID NO: 2863 - protein, 8 aa, Unknown
  Synthetic Peptide
QDNRGNSR

SEQ ID NO: 2864 - protein, 11 aa, Unknown
  Synthetic Peptide
QDNRGNSRDSK

SEQ ID NO: 2865 - protein, 8 aa, Unknown
  Synthetic Peptide
QDRLAKEK

SEQ ID NO: 2866 - protein, 11 aa, Unknown
  Synthetic Peptide
QGQQSDLEQER

SEQ ID NO: 2867 - protein, 8 aa, Unknown
  Synthetic Peptide
QSDLEQDR

SEQ ID NO: 2868 - protein, 11 aa, Unknown
  Synthetic Peptide
QSDLEQDRLAK

SEQ ID NO: 2869 - protein, 8 aa, Unknown
  Synthetic Peptide
QSDLEQER

SEQ ID NO: 2870 - protein, 11 aa, Unknown
  Synthetic Peptide
QSDLEQERLAK

SEQ ID NO: 2871 - protein, 9 aa, Unknown
  Synthetic Peptide
QSDLEQERR

SEQ ID NO: 2872 - protein, 11 aa, Unknown
  Synthetic Peptide
QSDLEQERRAK

SEQ ID NO: 2873 - protein, 8 aa, Unknown
  Synthetic Peptide
QSDLERTK

SEQ ID NO: 2874 - protein, 11 aa, Unknown
  Synthetic Peptide
QSDLERTKASK

SEQ ID NO: 2875 - protein, 8 aa, Unknown
  Synthetic Peptide
QSDSEQER

SEQ ID NO: 2876 - protein, 11 aa, Unknown
  Synthetic Peptide
QSDSEQERLAK

SEQ ID NO: 2877 - protein, 9 aa, Unknown
  Synthetic Peptide
QSSLPQDNR

SEQ ID NO: 2878 - protein, 9 aa, Unknown
  Synthetic Peptide
QTNFKSLLR

SEQ ID NO: 2879 - protein, 8 aa, Unknown
  Synthetic Peptide
QVNKEKEK

SEQ ID NO: 2880 - protein, 11 aa, Unknown
  Synthetic Peptide
QVNKEKEKFIK

SEQ ID NO: 2881 - protein, 11 aa, Unknown
  Synthetic Peptide
RDIHKGHLEEK

SEQ ID NO: 2882 - protein, 10 aa, Unknown
  Synthetic Peptide
RDLEQERLAK

SEQ ID NO: 2883 - protein, 8 aa, Unknown
  Synthetic Peptide
RDLEQERR

SEQ ID NO: 2884 - protein, 10 aa, Unknown
  Synthetic Peptide
RDLEQERRAK

SEQ ID NO: 2885 - protein, 11 aa, Unknown
  Synthetic Peptide
RDLEQRKADTK

SEQ ID NO: 2886 - protein, 11 aa, Unknown
  Synthetic Peptide
RDSKEISIIEK

SEQ ID NO: 2887 - protein, 8 aa, Unknown
  Synthetic Peptide
RGNSRDSK

SEQ ID NO: 2888 - protein, 9 aa, Unknown
  Synthetic Peptide
RINEEKHEK

SEQ ID NO: 2889 - protein, 10 aa, Unknown
  Synthetic Peptide
RINEEKHEKK

SEQ ID NO: 2890 - protein, 11 aa, Unknown
  Synthetic Peptide
RINEEKHEKKH

SEQ ID NO: 2891 - protein, 8 aa, Unknown
  Synthetic Peptide
RNRINEEK

SEQ ID NO: 2892 - protein, 9 aa, Unknown
  Synthetic Peptide
RNRINEEKH

SEQ ID NO: 2893 - protein, 11 aa, Unknown
  Synthetic Peptide
RNRINEEKHEK

SEQ ID NO: 2894 - protein, 8 aa, Unknown
  Synthetic Peptide
RSGSSNSR

SEQ ID NO: 2895 - protein, 10 aa, Unknown
  Synthetic Peptide
RSGSSNSRNR

SEQ ID NO: 2896 - protein, 10 aa, Unknown
  Synthetic Peptide
SDLEQDRLAK

SEQ ID NO: 2897 - protein, 10 aa, Unknown
  Synthetic Peptide
SDLEQERLAK

SEQ ID NO: 2898 - protein, 8 aa, Unknown
  Synthetic Peptide
SDLEQERR

SEQ ID NO: 2899 - protein, 10 aa, Unknown
  Synthetic Peptide
SDLEQERRAK

SEQ ID NO: 2900 - protein, 10 aa, Unknown
  Synthetic Peptide
SDLERTKASK

SEQ ID NO: 2901 - protein, 10 aa, Unknown
  Synthetic Peptide
SDSEQERLAK

SEQ ID NO: 2902 - protein, 10 aa, Unknown
  Synthetic Peptide
SDVNDFQISK

SEQ ID NO: 2903 - protein, 11 aa, Unknown
  Synthetic Peptide
SDVNDFQISKY

SEQ ID NO: 2904 - protein, 9 aa, Unknown
  Synthetic Peptide
SGSSNSRNR

SEQ ID NO: 2905 - protein, 8 aa, Unknown
  Synthetic Peptide
SIIEKTNR

SEQ ID NO: 2906 - protein, 10 aa, Unknown
  Synthetic Peptide
SIKPEQKEDK

SEQ ID NO: 2907 - protein, 9 aa, Unknown
  Synthetic Peptide
SITTNVEGR

SEQ ID NO: 2908 - protein, 10 aa, Unknown
  Synthetic Peptide
SITTNVEGRR

SEQ ID NO: 2909 - protein, 11 aa, Unknown
  Synthetic Peptide
SLPQDNRGNSR

SEQ ID NO: 2910 - protein, 8 aa, Unknown
  Synthetic Peptide
SLYDEHIK

SEQ ID NO: 2911 - protein, 9 aa, Unknown
  Synthetic Peptide
SLYDEHIKK

SEQ ID NO: 2912 - protein, 10 aa, Unknown
  Synthetic Peptide
SLYDEHIKKY

SEQ ID NO: 2913 - protein, 11 aa, Unknown
  Synthetic Peptide
SLYDEHIKKYK

SEQ ID NO: 2914 - protein, 11 aa, Unknown
  Synthetic Peptide
SNLRSGSSNSR

SEQ ID NO: 2915 - protein, 11 aa, Unknown
  Synthetic Peptide
SNSRNRINEEK

SEQ ID NO: 2916 - protein, 9 aa, Unknown
  Synthetic Peptide
SSEELSEEK

SEQ ID NO: 2917 - protein, 11 aa, Unknown
  Synthetic Peptide
SSEELSEEKIK

SEQ ID NO: 2918 - protein, 8 aa, Unknown
  Synthetic Peptide
SSLPQDNR

SEQ ID NO: 2919 - protein, 8 aa, Unknown
  Synthetic Peptide
TNFKSLLR

SEQ ID NO: 2920 - protein, 10 aa, Unknown
  Synthetic Peptide
TNVEGRRDIH

SEQ ID NO: 2921 - protein, 11 aa, Unknown
  Synthetic Peptide
TNVEGRRDIHK

SEQ ID NO: 2922 - protein, 8 aa, Unknown
  Synthetic Peptide
TTNVEGRR

SEQ ID NO: 2923 - protein, 11 aa, Unknown
  Synthetic Peptide
TTNVEGRRDIH

SEQ ID NO: 2924 - protein, 10 aa, Unknown
  Synthetic Peptide
VDELSEDITK

SEQ ID NO: 2925 - protein, 11 aa, Unknown
  Synthetic Peptide
VDELSEDITKY

SEQ ID NO: 2926 - protein, 9 aa, Unknown
  Synthetic Peptide
VLAEDLYGR

SEQ ID NO: 2927 - protein, 9 aa, Unknown
  Synthetic Peptide
VLSHNSYEK

SEQ ID NO: 2928 - protein, 11 aa, Unknown
  Synthetic Peptide
VLSHNSYEKTK

SEQ ID NO: 2929 - protein, 8 aa, Unknown
  Synthetic Peptide
VNDFQISK

SEQ ID NO: 2930 - protein, 9 aa, Unknown
  Synthetic Peptide
VNDFQISKY

SEQ ID NO: 2931 - protein, 10 aa, Unknown
  Synthetic Peptide
VNKEKEKFIK

SEQ ID NO: 2932 - protein, 11 aa, Unknown
  Synthetic Peptide
VNLLIFHINGK

SEQ ID NO: 2933 - protein, 8 aa, Unknown
  Synthetic Peptide
VSENIFLK

SEQ ID NO: 2934 - protein, 11 aa, Unknown
  Synthetic Peptide
VSENIFLKENK

SEQ ID NO: 2935 - protein, 11 aa, Unknown
  Synthetic Peptide
VSQTNFKSLLR

SEQ ID NO: 2936 - protein, 8 aa, Unknown
  Synthetic Peptide
YDEHIKKY

SEQ ID NO: 2937 - protein, 9 aa, Unknown
  Synthetic Peptide
YDEHIKKYK

SEQ ID NO: 2938 - protein, 11 aa, Unknown
  Synthetic Peptide
YFILVNLLIFH

SEQ ID NO: 2939 - protein, 9 aa, Unknown
  Synthetic Peptide
YIKGQDENR

SEQ ID NO: 2940 - protein, 8 aa, Unknown
  Synthetic Peptide
ACAGLAYK

SEQ ID NO: 2941 - protein, 9 aa, Unknown
  Synthetic Peptide
ADSAWENVK

SEQ ID NO: 2942 - protein, 10 aa, Unknown
  Synthetic Peptide
AFNRFLVGCH

SEQ ID NO: 2943 - protein, 10 aa, Unknown
  Synthetic Peptide
ALLACAGLAY

SEQ ID NO: 2944 - protein, 11 aa, Unknown
  Synthetic Peptide
ALLACAGLAYK

SEQ ID NO: 2945 - protein, 8 aa, Unknown
  Synthetic Peptide
ALLQVRKH

SEQ ID NO: 2946 - protein, 8 aa, Unknown
  Synthetic Peptide
AVCVEVEK

SEQ ID NO: 2947 - protein, 8 aa, Unknown
  Synthetic Peptide
CGKGTRSR

SEQ ID NO: 2948 - protein, 9 aa, Unknown
  Synthetic Peptide
CGKGTRSRK

SEQ ID NO: 2949 - protein, 10 aa, Unknown
  Synthetic Peptide
CGKGTRSRKR

SEQ ID NO: 2950 - protein, 8 aa, Unknown
  Synthetic Peptide
CNDEVDLY

SEQ ID NO: 2951 - protein, 8 aa, Unknown
  Synthetic Peptide
CSGSIRRH

SEQ ID NO: 2952 - protein, 10 aa, Unknown
  Synthetic Peptide
CSVTCGKGTR

SEQ ID NO: 2953 - protein, 8 aa, Unknown
  Synthetic Peptide
DALLQVRK

SEQ ID NO: 2954 - protein, 9 aa, Unknown
  Synthetic Peptide
DALLQVRKH

SEQ ID NO: 2955 - protein, 8 aa, Unknown
  Synthetic Peptide
DASKNKEK

SEQ ID NO: 2956 - protein, 8 aa, Unknown
  Synthetic Peptide
DCSGSIRR

SEQ ID NO: 2957 - protein, 9 aa, Unknown
  Synthetic Peptide
DCSGSIRRH

SEQ ID NO: 2958 - protein, 11 aa, Unknown
  Synthetic Peptide
DDREENFDIPK

SEQ ID NO: 2959 - protein, 9 aa, Unknown
  Synthetic Peptide
DIPKKPENK

SEQ ID NO: 2960 - protein, 10 aa, Unknown
  Synthetic Peptide
DIPKKPENKH

SEQ ID NO: 2961 - protein, 9 aa, Unknown
  Synthetic Peptide
DLDEPEQFR

SEQ ID NO: 2962 - protein, 8 aa, Unknown
  Synthetic Peptide
DLFLVNGR

SEQ ID NO: 2963 - protein, 10 aa, Unknown
  Synthetic Peptide
DNQNNLPNDK

SEQ ID NO: 2964 - protein, 8 aa, Unknown
  Synthetic Peptide
DSAWENVK

SEQ ID NO: 2965 - protein, 8 aa, Unknown
  Synthetic Peptide
DSIQDSLK

SEQ ID NO: 2966 - protein, 11 aa, Unknown
  Synthetic Peptide
DSIQDSLKESR

SEQ ID NO: 2967 - protein, 8 aa, Unknown
  Synthetic Peptide
DSLKESRK

SEQ ID NO: 2968 - protein, 10 aa, Unknown
  Synthetic Peptide
DVPKNPEDDR

SEQ ID NO: 2969 - protein, 11 aa, Unknown
  Synthetic Peptide
DVQNNIVDEIK

SEQ ID NO: 2970 - protein, 8 aa, Unknown
  Synthetic Peptide
EDDQPRPR

SEQ ID NO: 2971 - protein, 8 aa, Unknown
  Synthetic Peptide
EDRETRPH

SEQ ID NO: 2972 - protein, 10 aa, Unknown
  Synthetic Peptide
EDRETRPHGR

SEQ ID NO: 2973 - protein, 11 aa, Unknown
  Synthetic Peptide
EIIRLHSDASK

SEQ ID NO: 2974 - protein, 10 aa, Unknown
  Synthetic Peptide
ELQEQCEEER

SEQ ID NO: 2975 - protein, 8 aa, Unknown
  Synthetic Peptide
ENFDIPKK

SEQ ID NO: 2976 - protein, 8 aa, Unknown
  Synthetic Peptide
ENRSYNRK

SEQ ID NO: 2977 - protein, 8 aa, Unknown
  Synthetic Peptide
ETLGEEDK

SEQ ID NO: 2978 - protein, 10 aa, Unknown
  Synthetic Peptide
EVCNDEVDLY

SEQ ID NO: 2979 - protein, 8 aa, Unknown
  Synthetic Peptide
EVPSDVPK

SEQ ID NO: 2980 - protein, 10 aa, Unknown
  Synthetic Peptide
FDETLGEEDK

SEQ ID NO: 2981 - protein, 10 aa, Unknown
  Synthetic Peptide
FDIPKKPENK

SEQ ID NO: 2982 - protein, 11 aa, Unknown
  Synthetic Peptide
FDIPKKPENKH

SEQ ID NO: 2983 - protein, 9 aa, Unknown
  Synthetic Peptide
FDLFLVNGR

SEQ ID NO: 2984 - protein, 10 aa, Unknown
  Synthetic Peptide
FFDLFLVNGR

SEQ ID NO: 2985 - protein, 11 aa, Unknown
  Synthetic Peptide
FLVGCHPSDGK

SEQ ID NO: 2986 - protein, 11 aa, Unknown
  Synthetic Peptide
FMKAVCVEVEK

SEQ ID NO: 2987 - protein, 9 aa, Unknown
  Synthetic Peptide
FNRFLVGCH

SEQ ID NO: 2988 - protein, 10 aa, Unknown
  Synthetic Peptide
FVVPGAATPY

SEQ ID NO: 2989 - protein, 8 aa, Unknown
  Synthetic Peptide
GCHPSDGK

SEQ ID NO: 2990 - protein, 8 aa, Unknown
  Synthetic Peptide
GDNFAVEK

SEQ ID NO: 2991 - protein, 8 aa, Unknown
  Synthetic Peptide
GINVAFNR

SEQ ID NO: 2992 - protein, 11 aa, Unknown
  Synthetic Peptide
GIPDSIQDSLK

SEQ ID NO: 2993 - protein, 11 aa, Unknown
  Synthetic Peptide
GNRHVPNSEDR

SEQ ID NO: 2994 - protein, 11 aa, Unknown
  Synthetic Peptide
GSIRRHNWVNH

SEQ ID NO: 2995 - protein, 11 aa, Unknown
  Synthetic Peptide
GTRSRKREILH

SEQ ID NO: 2996 - protein, 8 aa, Unknown
  Synthetic Peptide
HAVPLAMK

SEQ ID NO: 2997 - protein, 11 aa, Unknown
  Synthetic Peptide
HDNQNNLPNDK

SEQ ID NO: 2998 - protein, 8 aa, Unknown
  Synthetic Peptide
HGRNNENR

SEQ ID NO: 2999 - protein, 10 aa, Unknown
  Synthetic Peptide
HGRNNENRSY

SEQ ID NO: 3000 - protein, 8 aa, Unknown
  Synthetic Peptide
HLNDRINR

SEQ ID NO: 3001 - protein, 8 aa, Unknown
  Synthetic Peptide
HSDASKNK

SEQ ID NO: 3002 - protein, 10 aa, Unknown
  Synthetic Peptide
HSDASKNKEK

SEQ ID NO: 3003 - protein, 8 aa, Unknown
  Synthetic Peptide
HVPNSEDR

SEQ ID NO: 3004 - protein, 11 aa, Unknown
  Synthetic Peptide
HVPNSEDRETR

SEQ ID NO: 3005 - protein, 11 aa, Unknown
  Synthetic Peptide
IFFDLFLVNGR

SEQ ID NO: 3006 - protein, 11 aa, Unknown
  Synthetic Peptide
IGQGINVAFNR

SEQ ID NO: 3007 - protein, 10 aa, Unknown
  Synthetic Peptide
IIRLHSDASK

SEQ ID NO: 3008 - protein, 8 aa, Unknown
  Synthetic Peptide
IVDEIKYR

SEQ ID NO: 3009 - protein, 9 aa, Unknown
  Synthetic Peptide
KAVCVEVEK

SEQ ID NO: 3010 - protein, 10 aa, Unknown
  Synthetic Peptide
KDLDEPEQFR

SEQ ID NO: 3011 - protein, 11 aa, Unknown
  Synthetic Peptide
KFVVPGAATPY

SEQ ID NO: 3012 - protein, 8 aa, Unknown
  Synthetic Peptide
KGTRSRKR

SEQ ID NO: 3013 - protein, 9 aa, Unknown
  Synthetic Peptide
KNVIGPFMK

SEQ ID NO: 3014 - protein, 8 aa, Unknown
  Synthetic Peptide
KVLDNERK

SEQ ID NO: 3015 - protein, 8 aa, Unknown
  Synthetic Peptide
LACAGLAY

SEQ ID NO: 3016 - protein, 9 aa, Unknown
  Synthetic Peptide
LACAGLAYK

SEQ ID NO: 3017 - protein, 11 aa, Unknown
  Synthetic Peptide
LALLACAGLAY

SEQ ID NO: 3018 - protein, 8 aa, Unknown
  Synthetic Peptide
LDEPEQFR

SEQ ID NO: 3019 - protein, 9 aa, Unknown
  Synthetic Peptide
LLACAGLAY

SEQ ID NO: 3020 - protein, 10 aa, Unknown
  Synthetic Peptide
LLACAGLAYK

SEQ ID NO: 3021 - protein, 10 aa, Unknown
  Synthetic Peptide
LLMDCSGSIR

SEQ ID NO: 3022 - protein, 11 aa, Unknown
  Synthetic Peptide
LLMDCSGSIRR

SEQ ID NO: 3023 - protein, 11 aa, Unknown
  Synthetic Peptide
LLQVRKHLNDR

SEQ ID NO: 3024 - protein, 8 aa, Unknown
  Synthetic Peptide
LLSTNLPY

SEQ ID NO: 3025 - protein, 10 aa, Unknown
  Synthetic Peptide
LLSTNLPYGR

SEQ ID NO: 3026 - protein, 9 aa, Unknown
  Synthetic Peptide
LMDCSGSIR

SEQ ID NO: 3027 - protein, 10 aa, Unknown
  Synthetic Peptide
LMDCSGSIRR

SEQ ID NO: 3028 - protein, 11 aa, Unknown
  Synthetic Peptide
LMDCSGSIRRH

SEQ ID NO: 3029 - protein, 9 aa, Unknown
  Synthetic Peptide
LSTNLPYGR

SEQ ID NO: 3030 - protein, 10 aa, Unknown
  Synthetic Peptide
LVGCHPSDGK

SEQ ID NO: 3031 - protein, 8 aa, Unknown
  Synthetic Peptide
MDCSGSIR

SEQ ID NO: 3032 - protein, 9 aa, Unknown
  Synthetic Peptide
MDCSGSIRR

SEQ ID NO: 3033 - protein, 10 aa, Unknown
  Synthetic Peptide
MDCSGSIRRH

SEQ ID NO: 3034 - protein, 8 aa, Unknown
  Synthetic Peptide
MNHLGNVK

SEQ ID NO: 3035 - protein, 9 aa, Unknown
  Synthetic Peptide
MNHLGNVKY

SEQ ID NO: 3036 - protein, 11 aa, Unknown
  Synthetic Peptide
NFDIPKKPENK

SEQ ID NO: 3037 - protein, 8 aa, Unknown
  Synthetic Peptide
NIPEDSEK

SEQ ID NO: 3038 - protein, 8 aa, Unknown
  Synthetic Peptide
NIVDEIKY

SEQ ID NO: 3039 - protein, 9 aa, Unknown
  Synthetic Peptide
NIVDEIKYR

SEQ ID NO: 3040 - protein, 9 aa, Unknown
  Synthetic Peptide
NLPNDKSDR

SEQ ID NO: 3041 - protein, 9 aa, Unknown
  Synthetic Peptide
NNENRSYNR

SEQ ID NO: 3042 - protein, 10 aa, Unknown
  Synthetic Peptide
NNENRSYNRK

SEQ ID NO: 3043 - protein, 8 aa, Unknown
  Synthetic Peptide
NNIVDEIK

SEQ ID NO: 3044 - protein, 9 aa, Unknown
  Synthetic Peptide
NNIVDEIKY

SEQ ID NO: 3045 - protein, 10 aa, Unknown
  Synthetic Peptide
NNIVDEIKYR

SEQ ID NO: 3046 - protein, 10 aa, Unknown
  Synthetic Peptide
NNLPNDKSDR

SEQ ID NO: 3047 - protein, 8 aa, Unknown
  Synthetic Peptide
NSEDRETR

SEQ ID NO: 3048 - protein, 10 aa, Unknown
  Synthetic Peptide
NSEDRETRPH

SEQ ID NO: 3049 - protein, 8 aa, Unknown
  Synthetic Peptide
NVIGPFMK

SEQ ID NO: 3050 - protein, 11 aa, Unknown
  Synthetic Peptide
NVKNVIGPFMK

SEQ ID NO: 3051 - protein, 8 aa, Unknown
  Synthetic Peptide
PCSVTCGK

SEQ ID NO: 3052 - protein, 11 aa, Unknown
  Synthetic Peptide
PCSVTCGKGTR

SEQ ID NO: 3053 - protein, 9 aa, Unknown
  Synthetic Peptide
PDSIQDSLK

SEQ ID NO: 3054 - protein, 11 aa, Unknown
  Synthetic Peptide
PFDETLGEEDK

SEQ ID NO: 3055 - protein, 9 aa, Unknown
  Synthetic Peptide
PNIPEDSEK

SEQ ID NO: 3056 - protein, 9 aa, Unknown
  Synthetic Peptide
PNSEDRETR

SEQ ID NO: 3057 - protein, 11 aa, Unknown
  Synthetic Peptide
PNSEDRETRPH

SEQ ID NO: 3058 - protein, 9 aa, Unknown
  Synthetic Peptide
PSDGKCNLY

SEQ ID NO: 3059 - protein, 9 aa, Unknown
  Synthetic Peptide
PSPNPEEGK

SEQ ID NO: 3060 - protein, 10 aa, Unknown
  Synthetic Peptide
QCEEERCPPK

SEQ ID NO: 3061 - protein, 8 aa, Unknown
  Synthetic Peptide
QDNNGNRH

SEQ ID NO: 3062 - protein, 8 aa, Unknown
  Synthetic Peptide
QDSLKESR

SEQ ID NO: 3063 - protein, 9 aa, Unknown
  Synthetic Peptide
QDSLKESRK

SEQ ID NO: 3064 - protein, 9 aa, Unknown
  Synthetic Peptide
QGINVAFNR

SEQ ID NO: 3065 - protein, 9 aa, Unknown
  Synthetic Peptide
QNNIVDEIK

SEQ ID NO: 3066 - protein, 10 aa, Unknown
  Synthetic Peptide
QNNIVDEIKY

SEQ ID NO: 3067 - protein, 11 aa, Unknown
  Synthetic Peptide
QNNIVDEIKYR

SEQ ID NO: 3068 - protein, 8 aa, Unknown
  Synthetic Peptide
QNNLPNDK

SEQ ID NO: 3069 - protein, 11 aa, Unknown
  Synthetic Peptide
QNNLPNDKSDR

SEQ ID NO: 3070 - protein, 9 aa, Unknown
  Synthetic Peptide
QSQDNNGNR

SEQ ID NO: 3071 - protein, 10 aa, Unknown
  Synthetic Peptide
QSQDNNGNRH

SEQ ID NO: 3072 - protein, 9 aa, Unknown
  Synthetic Peptide
QVRKHLNDR

SEQ ID NO: 3073 - protein, 9 aa, Unknown
  Synthetic Peptide
RGDNFAVEK

SEQ ID NO: 3074 - protein, 8 aa, Unknown
  Synthetic Peptide
RLHSDASK

SEQ ID NO: 3075 - protein, 10 aa, Unknown
  Synthetic Peptide
RLHSDASKNK

SEQ ID NO: 3076 - protein, 8 aa, Unknown
  Synthetic Peptide
RNNENRSY

SEQ ID NO: 3077 - protein, 10 aa, Unknown
  Synthetic Peptide
RNNENRSYNR

SEQ ID NO: 3078 - protein, 11 aa, Unknown
  Synthetic Peptide
RNNENRSYNRK

SEQ ID NO: 3079 - protein, 9 aa, Unknown
  Synthetic Peptide
RSRKREILH

SEQ ID NO: 3080 - protein, 9 aa, Unknown
  Synthetic Peptide
SDASKNKEK

SEQ ID NO: 3081 - protein, 8 aa, Unknown
  Synthetic Peptide
SDGKCNLY

SEQ ID NO: 3082 - protein, 11 aa, Unknown
  Synthetic Peptide
SDVPKNPEDDR

SEQ ID NO: 3083 - protein, 10 aa, Unknown
  Synthetic Peptide
SIQDSLKESR

SEQ ID NO: 3084 - protein, 11 aa, Unknown
  Synthetic Peptide
SIQDSLKESRK

SEQ ID NO: 3085 - protein, 10 aa, Unknown
  Synthetic Peptide
SIRRHNWVNH

SEQ ID NO: 3086 - protein, 9 aa, Unknown
  Synthetic Peptide
SLLSTNLPY

SEQ ID NO: 3087 - protein, 11 aa, Unknown
  Synthetic Peptide
SLLSTNLPYGR

SEQ ID NO: 3088 - protein, 8 aa, Unknown
  Synthetic Peptide
STNLPYGR

SEQ ID NO: 3089 - protein, 9 aa, Unknown
  Synthetic Peptide
SVTCGKGTR

SEQ ID NO: 3090 - protein, 11 aa, Unknown
  Synthetic Peptide
SVTCGKGTRSR

SEQ ID NO: 3091 - protein, 9 aa, Unknown
  Synthetic Peptide
TCGKGTRSR

SEQ ID NO: 3092 - protein, 10 aa, Unknown
  Synthetic Peptide
TCGKGTRSRK

SEQ ID NO: 3093 - protein, 11 aa, Unknown
  Synthetic Peptide
TCGKGTRSRKR

SEQ ID NO: 3094 - protein, 11 aa, Unknown
  Synthetic Peptide
VAFNRFLVGCH

SEQ ID NO: 3095 - protein, 9 aa, Unknown
  Synthetic Peptide
VCNDEVDLY

SEQ ID NO: 3096 - protein, 9 aa, Unknown
  Synthetic Peptide
VGCHPSDGK

SEQ ID NO: 3097 - protein, 10 aa, Unknown
  Synthetic Peptide
VNHAVPLAMK

SEQ ID NO: 3098 - protein, 8 aa, Unknown
  Synthetic Peptide
VTCGKGTR

SEQ ID NO: 3099 - protein, 10 aa, Unknown
  Synthetic Peptide
VTCGKGTRSR

SEQ ID NO: 3100 - protein, 11 aa, Unknown
  Synthetic Peptide
VTCGKGTRSRK

SEQ ID NO: 3101 - protein, 9 aa, Unknown
  Synthetic Peptide
VVPGAATPY

SEQ ID NO: 3102 - protein, 10 aa, Unknown
  Synthetic Peptide
WSPCSVTCGK

SEQ ID NO: 3103 - protein, 11 aa, Unknown
  Synthetic Peptide
WVNHAVPLAMK

SEQ ID NO: 3104 - protein, 10 aa, Unknown
  Synthetic Peptide
YADSAWENVK

SEQ ID NO: 3105 - protein, 11 aa, Unknown
  Synthetic Peptide
YLLMDCSGSIR

SEQ ID NO: 3106 - protein, 11 aa, Unknown
  Synthetic Peptide
CYGSSSNTRVL

SEQ ID NO: 3107 - protein, 10 aa, Unknown
  Synthetic Peptide
DYENDIEKKI

SEQ ID NO: 3108 - protein, 11 aa, Unknown
  Synthetic Peptide
EMNYYGKQENW

SEQ ID NO: 3109 - protein, 8 aa, Unknown
  Synthetic Peptide
IMVLSFLF

SEQ ID NO: 3110 - protein, 9 aa, Unknown
  Synthetic Peptide
IMVLSFLFL

SEQ ID NO: 3111 - protein, 9 aa, Unknown
  Synthetic Peptide
KMEKCSSVF

SEQ ID NO: 3112 - protein, 8 aa, Unknown
  Synthetic Peptide
MMRKLAIL

SEQ ID NO: 3113 - protein, 9 aa, Unknown
  Synthetic Peptide
NYDNAGINL

SEQ ID NO: 3114 - protein, 9 aa, Unknown
  Synthetic Peptide
NYYGKQENW

SEQ ID NO: 3115 - protein, 8 aa, Unknown
  Synthetic Peptide
SFLFVEAL

SEQ ID NO: 3116 - protein, 9 aa, Unknown
  Synthetic Peptide
SFLFVEALF

SEQ ID NO: 3117 - protein, 9 aa, Unknown
  Synthetic Peptide
VFNVVNSSI

SEQ ID NO: 3118 - protein, 11 aa, Unknown
  Synthetic Peptide
VFNVVNSSIGL

SEQ ID NO: 3119 - protein, 11 aa, Unknown
  Synthetic Peptide
WYSLKKNSRSL

SEQ ID NO: 3120 - protein, 8 aa, Unknown
  Synthetic Peptide
YYGKQENW

SEQ ID NO: 3121 - protein, 11 aa, Unknown
  Synthetic Peptide
YYGKQENWYSL

SEQ ID NO: 3122 - protein, 9 aa, Unknown
  Synthetic Peptide
DMIKKEEEL

SEQ ID NO: 3123 - protein, 10 aa, Unknown
  Synthetic Peptide
FFIIFNKESL

SEQ ID NO: 3124 - protein, 8 aa, Unknown
  Synthetic Peptide
FFLALFFI

SEQ ID NO: 3125 - protein, 9 aa, Unknown
  Synthetic Peptide
FFLALFFII

SEQ ID NO: 3126 - protein, 10 aa, Unknown
  Synthetic Peptide
FFLALFFIIF

SEQ ID NO: 3127 - protein, 9 aa, Unknown
  Synthetic Peptide
KYKLATSVL

SEQ ID NO: 3128 - protein, 11 aa, Unknown
  Synthetic Peptide
LFFIIFNKESL

SEQ ID NO: 3129 - protein, 11 aa, Unknown
  Synthetic Peptide
LYNTEKGRHPF

SEQ ID NO: 3130 - protein, 8 aa, Unknown
  Synthetic Peptide
VFFLALFF

SEQ ID NO: 3131 - protein, 9 aa, Unknown
  Synthetic Peptide
VFFLALFFI

SEQ ID NO: 3132 - protein, 10 aa, Unknown
  Synthetic Peptide
VFFLALFFII

SEQ ID NO: 3133 - protein, 11 aa, Unknown
  Synthetic Peptide
VFFLALFFIIF

SEQ ID NO: 3134 - protein, 11 aa, Unknown
  Synthetic Peptide
DFQISKYEDEI

SEQ ID NO: 3135 - protein, 11 aa, Unknown
  Synthetic Peptide
EFKPIVQYDNF

SEQ ID NO: 3136 - protein, 8 aa, Unknown
  Synthetic Peptide
FFDKDKEL

SEQ ID NO: 3137 - protein, 8 aa, Unknown
  Synthetic Peptide
FYFILVNL

SEQ ID NO: 3138 - protein, 9 aa, Unknown
  Synthetic Peptide
FYFILVNLL

SEQ ID NO: 3139 - protein, 10 aa, Unknown
  Synthetic Peptide
FYFILVNLLI

SEQ ID NO: 3140 - protein, 11 aa, Unknown
  Synthetic Peptide
FYFILVNLLIF

SEQ ID NO: 3141 - protein, 10 aa, Unknown
  Synthetic Peptide
GYYIPHQSSL

SEQ ID NO: 3142 - protein, 8 aa, Unknown
  Synthetic Peptide
IFDGDNEI

SEQ ID NO: 3143 - protein, 9 aa, Unknown
  Synthetic Peptide
IFDGDNEIL

SEQ ID NO: 3144 - protein, 11 aa, Unknown
  Synthetic Peptide
IFDGDNEILQI

SEQ ID NO: 3145 - protein, 8 aa, Unknown
  Synthetic Peptide
IFHINGKI

SEQ ID NO: 3146 - protein, 9 aa, Unknown
  Synthetic Peptide
IFHINGKII

SEQ ID NO: 3147 - protein, 8 aa, Unknown
  Synthetic Peptide
IFLKENKL

SEQ ID NO: 3148 - protein, 8 aa, Unknown
  Synthetic Peptide
IYKELEDL

SEQ ID NO: 3149 - protein, 9 aa, Unknown
  Synthetic Peptide
IYKELEDLI

SEQ ID NO: 3150 - protein, 9 aa, Unknown
  Synthetic Peptide
KFFDKDKEL

SEQ ID NO: 3151 - protein, 9 aa, Unknown
  Synthetic Peptide
KFIKSLFHI

SEQ ID NO: 3152 - protein, 10 aa, Unknown
  Synthetic Peptide
KFIKSLFHIF

SEQ ID NO: 3153 - protein, 10 aa, Unknown
  Synthetic Peptide
KYEKTKDNNF

SEQ ID NO: 3154 - protein, 11 aa, Unknown
  Synthetic Peptide
LFHIFDGDNEI

SEQ ID NO: 3155 - protein, 10 aa, Unknown
  Synthetic Peptide
LYGRLEIPAI

SEQ ID NO: 3156 - protein, 8 aa, Unknown
  Synthetic Peptide
LYISFYFI

SEQ ID NO: 3157 - protein, 9 aa, Unknown
  Synthetic Peptide
LYISFYFIL

SEQ ID NO: 3158 - protein, 9 aa, Unknown
  Synthetic Peptide
NFKPNDKSL

SEQ ID NO: 3159 - protein, 9 aa, Unknown
  Synthetic Peptide
NFKSLLRNL

SEQ ID NO: 3160 - protein, 8 aa, Unknown
  Synthetic Peptide
NFQDEENI

SEQ ID NO: 3161 - protein, 10 aa, Unknown
  Synthetic Peptide
NFQDEENIGI

SEQ ID NO: 3162 - protein, 11 aa, Unknown
  Synthetic Peptide
QYDNFQDEENI

SEQ ID NO: 3163 - protein, 9 aa, Unknown
  Synthetic Peptide
SFYFILVNL

SEQ ID NO: 3164 - protein, 10 aa, Unknown
  Synthetic Peptide
SFYFILVNLL

SEQ ID NO: 3165 - protein, 11 aa, Unknown
  Synthetic Peptide
SFYFILVNLLI

SEQ ID NO: 3166 - protein, 8 aa, Unknown
  Synthetic Peptide
YFILVNLL

SEQ ID NO: 3167 - protein, 9 aa, Unknown
  Synthetic Peptide
YFILVNLLI

SEQ ID NO: 3168 - protein, 10 aa, Unknown
  Synthetic Peptide
YFILVNLLIF

SEQ ID NO: 3169 - protein, 9 aa, Unknown
  Synthetic Peptide
YYIPHQSSL

SEQ ID NO: 3170 - protein, 8 aa, Unknown
  Synthetic Peptide
AMKLIQQL

SEQ ID NO: 3171 - protein, 10 aa, Unknown
  Synthetic Peptide
AMKLIQQLNL

SEQ ID NO: 3172 - protein, 9 aa, Unknown
  Synthetic Peptide
AWENVKNVI

SEQ ID NO: 3173 - protein, 8 aa, Unknown
  Synthetic Peptide
KYKIAGGI

SEQ ID NO: 3174 - protein, 8 aa, Unknown
  Synthetic Peptide
KYLVIVFL

SEQ ID NO: 3175 - protein, 9 aa, Unknown
  Synthetic Peptide
KYLVIVFLI

SEQ ID NO: 3176 - protein, 10 aa, Unknown
  Synthetic Peptide
KYLVIVFLIF

SEQ ID NO: 3177 - protein, 11 aa, Unknown
  Synthetic Peptide
KYLVIVFLIFF

SEQ ID NO: 3178 - protein, 8 aa, Unknown
  Synthetic Peptide
LMDCSGSI

SEQ ID NO: 3179 - protein, 11 aa, Unknown
  Synthetic Peptide
LYLLMDCSGSI

SEQ ID NO: 3180 - protein, 9 aa, Unknown
  Synthetic Peptide
NWVNHAVPL

SEQ ID NO: 3181 - protein, 9 aa, Unknown
  Synthetic Peptide
PYAGEPAPF

SEQ ID NO: 3182 - protein, 10 aa, Unknown
  Synthetic Peptide
QFRLPEENEW

SEQ ID NO: 3183 - protein, 8 aa, Unknown
  Synthetic Peptide
VFGIGQGI

SEQ ID NO: 3184 - protein, 8 aa, Unknown
  Synthetic Peptide
VFLIFFDL

SEQ ID NO: 3185 - protein, 9 aa, Unknown
  Synthetic Peptide
VFLIFFDLF

SEQ ID NO: 3186 - protein, 10 aa, Unknown
  Synthetic Peptide
VFLIFFDLFL

SEQ ID NO: 3187 - protein, 9 aa, Unknown
  Synthetic Peptide
FLFVEALFQ

SEQ ID NO: 3188 - protein, 9 aa, Unknown
  Synthetic Peptide
FNVVNSSIG

SEQ ID NO: 3189 - protein, 9 aa, Unknown
  Synthetic Peptide
FQEYQCYGS

SEQ ID NO: 3190 - protein, 9 aa, Unknown
  Synthetic Peptide
IEKKICKME

SEQ ID NO: 3191 - protein, 9 aa, Unknown
  Synthetic Peptide
IGLIMVLSF

SEQ ID NO: 3192 - protein, 9 aa, Unknown
  Synthetic Peptide
ILSVSSFLF

SEQ ID NO: 3193 - protein, 9 aa, Unknown
  Synthetic Peptide
LAILSVSSF

SEQ ID NO: 3194 - protein, 9 aa, Unknown
  Synthetic Peptide
MEKCSSVFN

SEQ ID NO: 3195 - protein, 9 aa, Unknown
  Synthetic Peptide
VVNSSIGLI

SEQ ID NO: 3196 - protein, 9 aa, Unknown
  Synthetic Peptide
YQCYGSSSN

SEQ ID NO: 3197 - protein, 9 aa, Unknown
  Synthetic Peptide
YNELEMNYY

SEQ ID NO: 3198 - protein, 9 aa, Unknown
  Synthetic Peptide
YDNAGINLY

SEQ ID NO: 3199 - protein, 9 aa, Unknown
  Synthetic Peptide
IQNSLSTEW

SEQ ID NO: 3200 - protein, 9 aa, Unknown
  Synthetic Peptide
WSPCSVTCG

SEQ ID NO: 3201 - protein, 9 aa, Unknown
  Synthetic Peptide
FILVNLLIF

SEQ ID NO: 3202 - protein, 9 aa, Unknown
  Synthetic Peptide
FYFILVNLL

SEQ ID NO: 3203 - protein, 9 aa, Unknown
  Synthetic Peptide
IHKGHLEEK

SEQ ID NO: 3204 - protein, 9 aa, Unknown
  Synthetic Peptide
IIKSNLRSG

SEQ ID NO: 3205 - protein, 9 aa, Unknown
  Synthetic Peptide
ILVNLLIFH

SEQ ID NO: 3206 - protein, 9 aa, Unknown
  Synthetic Peptide
INGKIIKNS

SEQ ID NO: 3207 - protein, 9 aa, Unknown
  Synthetic Peptide
IPAIELPSE

SEQ ID NO: 3208 - protein, 9 aa, Unknown
  Synthetic Peptide
IPHQSSLPQ

SEQ ID NO: 3209 - protein, 9 aa, Unknown
  Synthetic Peptide
IQNHTLETV

SEQ ID NO: 3210 - protein, 9 aa, Unknown
  Synthetic Peptide
ISFYFILVN

SEQ ID NO: 3211 - protein, 9 aa, Unknown
  Synthetic Peptide
LDEFKPIVQ

SEQ ID NO: 3212 - protein, 9 aa, Unknown
  Synthetic Peptide
LEEKAAKET

SEQ ID NO: 3213 - protein, 9 aa, Unknown
  Synthetic Peptide
LEIPAIELP

SEQ ID NO: 3214 - protein, 9 aa, Unknown
  Synthetic Peptide
LEQRKADTK

SEQ ID NO: 3215 - protein, 9 aa, Unknown
  Synthetic Peptide
LERTKASKE

SEQ ID NO: 3216 - protein, 9 aa, Unknown
  Synthetic Peptide
LETVNISDV

SEQ ID NO: 3217 - protein, 9 aa, Unknown
  Synthetic Peptide
LIEHIINDD

SEQ ID NO: 3218 - protein, 9 aa, Unknown
  Synthetic Peptide
LKENKLNKE

SEQ ID NO: 3219 - protein, 9 aa, Unknown
  Synthetic Peptide
LLIFHINGK

SEQ ID NO: 3220 - protein, 9 aa, Unknown
  Synthetic Peptide
LQEQQSDLE

SEQ ID NO: 3221 - protein, 9 aa, Unknown
  Synthetic Peptide
LQEQQSDSE

SEQ ID NO: 3222 - protein, 9 aa, Unknown
  Synthetic Peptide
LQGQQSDLE

SEQ ID NO: 3223 - protein, 9 aa, Unknown
  Synthetic Peptide
LRNLGVSEN

SEQ ID NO: 3224 - protein, 9 aa, Unknown
  Synthetic Peptide
LRSGSSNSR

SEQ ID NO: 3225 - protein, 9 aa, Unknown
  Synthetic Peptide
LTMSNVKNV

SEQ ID NO: 3226 - protein, 9 aa, Unknown
  Synthetic Peptide
LVNLLIFHI

SEQ ID NO: 3227 - protein, 9 aa, Unknown
  Synthetic Peptide
VLSHNSYEK

SEQ ID NO: 3228 - protein, 9 aa, Unknown
  Synthetic Peptide
VNDFQISKY

SEQ ID NO: 3229 - protein, 9 aa, Unknown
  Synthetic Peptide
VNISDVNDF

SEQ ID NO: 3230 - protein, 9 aa, Unknown
  Synthetic Peptide
YDDSLIDEE

SEQ ID NO: 3231 - protein, 9 aa, Unknown
  Synthetic Peptide
YGRLEIPAI

SEQ ID NO: 3232 - protein, 9 aa, Unknown
  Synthetic Peptide
YIPHQSSLP

SEQ ID NO: 3233 - protein, 9 aa, Unknown
  Synthetic Peptide
FKIGSSDPA

SEQ ID NO: 3234 - protein, 9 aa, Unknown
  Synthetic Peptide
IDVHDLISD

SEQ ID NO: 3235 - protein, 9 aa, Unknown
  Synthetic Peptide
IFNKESLAE

SEQ ID NO: 3236 - protein, 9 aa, Unknown
  Synthetic Peptide
IGSSDPADN

SEQ ID NO: 3237 - protein, 9 aa, Unknown
  Synthetic Peptide
LALFFIIFN

SEQ ID NO: 3238 - protein, 9 aa, Unknown
  Synthetic Peptide
LATSVLAGL

SEQ ID NO: 3239 - protein, 9 aa, Unknown
  Synthetic Peptide
LGGVGLVLY

SEQ ID NO: 3240 - protein, 9 aa, Unknown
  Synthetic Peptide
LGNVSTVLL

SEQ ID NO: 3241 - protein, 9 aa, Unknown
  Synthetic Peptide
LLGNVSTVL

SEQ ID NO: 3242 - protein, 9 aa, Unknown
  Synthetic Peptide
LSVFFLALF

SEQ ID NO: 3243 - protein, 9 aa, Unknown
  Synthetic Peptide
LVLYNTEKG

SEQ ID NO: 3244 - protein, 9 aa, Unknown
  Synthetic Peptide
VFFLALFFI

SEQ ID NO: 3245 - protein, 9 aa, Unknown
  Synthetic Peptide
VHDLISDMI

SEQ ID NO: 3246 - protein, 9 aa, Unknown
  Synthetic Peptide
VLAGLLGNV

SEQ ID NO: 3247 - protein, 9 aa, Unknown
  Synthetic Peptide
VLLGGVGLV

SEQ ID NO: 3248 - protein, 9 aa, Unknown
  Synthetic Peptide
VNKRKSKYK

SEQ ID NO: 3249 - protein, 9 aa, Unknown
  Synthetic Peptide
VSTVLLGGV

SEQ ID NO: 3250 - protein, 9 aa, Unknown
  Synthetic Peptide
VTAQDVTPE

SEQ ID NO: 3251 - protein, 9 aa, Unknown
  Synthetic Peptide
YKLATSVLA

SEQ ID NO: 3252 - protein, 9 aa, Unknown
  Synthetic Peptide
FDLFLVNGR

SEQ ID NO: 3253 - protein, 9 aa, Unknown
  Synthetic Peptide
FFDLFLVNG

SEQ ID NO: 3254 - protein, 9 aa, Unknown
  Synthetic Peptide
FMKAVCVEV

SEQ ID NO: 3255 - protein, 9 aa, Unknown
  Synthetic Peptide
FNRFLVGCH

SEQ ID NO: 3256 - protein, 9 aa, Unknown
  Synthetic Peptide
IAGGLALLA

SEQ ID NO: 3257 - protein, 9 aa, Unknown
  Synthetic Peptide
IAVFGIGQG

SEQ ID NO: 3258 - protein, 9 aa, Unknown
  Synthetic Peptide
LACAGLAYK

SEQ ID NO: 3259 - protein, 9 aa, Unknown
  Synthetic Peptide
LALLACAGL

SEQ ID NO: 3260 - protein, 9 aa, Unknown
  Synthetic Peptide
LAMKLIQQL

SEQ ID NO: 3261 - protein, 9 aa, Unknown
  Synthetic Peptide
LAYKFVVPG

SEQ ID NO: 3262 - protein, 9 aa, Unknown
  Synthetic Peptide
LIFFDLFLV

SEQ ID NO: 3263 - protein, 9 aa, Unknown
  Synthetic Peptide
LTDGIPDSI

SEQ ID NO: 3264 - protein, 9 aa, Unknown
  Synthetic Peptide
LVGCHPSDG

SEQ ID NO: 3265 - protein, 9 aa, Unknown
  Synthetic Peptide
LVIVFLIFF

SEQ ID NO: 3266 - protein, 9 aa, Unknown
  Synthetic Peptide
LVVILTDGI

SEQ ID NO: 3267 - protein, 9 aa, Unknown
  Synthetic Peptide
MDCSGSIRR

SEQ ID NO: 3268 - protein, 9 aa, Unknown
  Synthetic Peptide
MKAVCVEVE

SEQ ID NO: 3269 - protein, 9 aa, Unknown
  Synthetic Peptide
VEKTASCGV

SEQ ID NO: 3270 - protein, 9 aa, Unknown
  Synthetic Peptide
VGCHPSDGK

SEQ ID NO: 3271 - protein, 9 aa, Unknown
  Synthetic Peptide
VIGPFMKAV

SEQ ID NO: 3272 - protein, 9 aa, Unknown
  Synthetic Peptide
VIVFLIFFD

SEQ ID NO: 3273 - protein, 9 aa, Unknown
  Synthetic Peptide
VKYLVIVFL

SEQ ID NO: 3274 - protein, 9 aa, Unknown
  Synthetic Peptide
VNGRDVQNN

SEQ ID NO: 3275 - protein, 9 aa, Unknown
  Synthetic Peptide
WDEWSPCSV

SEQ ID NO: 3276 - protein, 9 aa, Unknown
  Synthetic Peptide
IAGGIAGGL

SEQ ID NO: 3277 - protein, 9 aa, Unknown
  Synthetic Peptide
VQNNIVDEI

SEQ ID NO: 3278 - protein, 9 aa, Unknown
  Synthetic Peptide
YLLMDCSGS

SEQ ID NO: 3279 - protein, 9 aa, Unknown
  Synthetic Peptide
FVVPGAATP

SEQ ID NO: 3280 - protein, 9 aa, Unknown
  Synthetic Peptide
YKFVVPGAA

SEQ ID NO: 3281 - protein, 9 aa, Unknown
  Synthetic Peptide
IIRLHSDAS

SEQ ID NO: 3282 - protein, 9 aa, Unknown
  Synthetic Peptide
IIDNNPQEP

SEQ ID NO: 3283 - protein, 9 aa, Unknown
  Synthetic Peptide
VDLYLLMDC

SEQ ID NO: 3284 - protein, 9 aa, Unknown
  Synthetic Peptide
LLSTNLPYG

SEQ ID NO: 3285 - protein, 9 aa, Unknown
  Synthetic Peptide
LHEGCTSEL

SEQ ID NO: 3286 - protein, 9 aa, Unknown
  Synthetic Peptide
VNHAVPLAM

SEQ ID NO: 3287 - protein, 9 aa, Unknown
  Synthetic Peptide
VPGAATPYA

SEQ ID NO: 3288 - protein, 9 aa, Unknown
  Synthetic Peptide
VVPGAATPY

SEQ ID NO: 3289 - protein, 9 aa, Unknown
  Synthetic Peptide
WVNHAVPLA

SEQ ID NO: 3290 - protein, 9 aa, Unknown
  Synthetic Peptide
LSTNLPYGR

SEQ ID NO: 3291 - protein, 15 aa, Unknown
  Synthetic Peptide
VSSFLFVEALFQEYQ

SEQ ID NO: 3292 - protein, 15 aa, Unknown
  Synthetic Peptide
SSVFNVVNSSIGLIM

SEQ ID NO: 3293 - protein, 15 aa, Unknown
  Synthetic Peptide
EALFQEYQCYGSSSN

SEQ ID NO: 3294 - protein, 15 aa, Unknown
  Synthetic Peptide
ENDIEKKICKMEKCS

SEQ ID NO: 3295 - protein, 15 aa, Unknown
  Synthetic Peptide
NSSIGLIMVLSFLFL

SEQ ID NO: 3296 - protein, 15 aa, Unknown
  Synthetic Peptide
KLAILSVSSFLFVEA

SEQ ID NO: 3297 - protein, 15 aa, Unknown
  Synthetic Peptide
MRKLAILSVSSFLFV

SEQ ID NO: 3298 - protein, 15 aa, Unknown
  Synthetic Peptide
ICKMEKCSSVFNVVN

SEQ ID NO: 3299 - protein, 15 aa, Unknown
  Synthetic Peptide
VFNVVNSSIGLIMVL

SEQ ID NO: 3300 - protein, 15 aa, Unknown
  Synthetic Peptide
FQEYQCYGSSSNTRV

SEQ ID NO: 3301 - protein, 15 aa, Unknown
  Synthetic Peptide
INLYNELEMNYYGKQ

SEQ ID NO: 3302 - protein, 15 aa, Unknown
  Synthetic Peptide
ELNYDNAGINLYNEL

SEQ ID NO: 3303 - protein, 15 aa, Unknown
  Synthetic Peptide
LKKIQNSLSTEWSPC

SEQ ID NO: 3304 - protein, 15 aa, Unknown
  Synthetic Peptide
STEWSPCSVTCGNGI

SEQ ID NO: 3305 - protein, 15 aa, Unknown
  Synthetic Peptide
SFYFILVNLLIFHIN

SEQ ID NO: 3306 - protein, 15 aa, Unknown
  Synthetic Peptide
YISFYFILVNLLIFH

SEQ ID NO: 3307 - protein, 15 aa, Unknown
  Synthetic Peptide
RRDIHKGHLEEKKDG

SEQ ID NO: 3308 - protein, 15 aa, Unknown
  Synthetic Peptide
KDEIIKSNLRSGSSN

SEQ ID NO: 3309 - protein, 15 aa, Unknown
  Synthetic Peptide
FYFILVNLLIFHING

SEQ ID NO: 3310 - protein, 15 aa, Unknown
  Synthetic Peptide
IFHINGKIIKNSEKD

SEQ ID NO: 3311 - protein, 15 aa, Unknown
  Synthetic Peptide
RLEIPAIELPSENER

SEQ ID NO: 3312 - protein, 15 aa, Unknown
  Synthetic Peptide
GYYIPHQSSLPQDNR

SEQ ID NO: 3313 - protein, 15 aa, Unknown
  Synthetic Peptide
SADIQNHTLETVNIS

SEQ ID NO: 3314 - protein, 15 aa, Unknown
  Synthetic Peptide
ILYISFYFILVNLLI

SEQ ID NO: 3315 - protein, 15 aa, Unknown
  Synthetic Peptide
DEDLDEFKPIVQYDN

SEQ ID NO: 3316 - protein, 15 aa, Unknown
  Synthetic Peptide
QEDLEEKAAKETLQG

SEQ ID NO: 3317 - protein, 15 aa, Unknown
  Synthetic Peptide
YGRLEIPAIELPSEN

SEQ ID NO: 3318 - protein, 15 aa, Unknown
  Synthetic Peptide
QRDLEQRKADTKKNL

SEQ ID NO: 3319 - protein, 15 aa, Unknown
  Synthetic Peptide
QSDLERTKASKETLQ

SEQ ID NO: 3320 - protein, 15 aa, Unknown
  Synthetic Peptide
NHTLETVNISDVNDF

SEQ ID NO: 3321 - protein, 15 aa, Unknown
  Synthetic Peptide
EGKLIEHIINDDDDK

SEQ ID NO: 3322 - protein, 15 aa, Unknown
  Synthetic Peptide
NIFLKENKLNKEGKL

SEQ ID NO: 3323 - protein, 15 aa, Unknown
  Synthetic Peptide
LVNLLIFHINGKIIK

SEQ ID NO: 3324 - protein, 15 aa, Unknown
  Synthetic Peptide
KETLQEQQSDLEQER

SEQ ID NO: 3325 - protein, 15 aa, Unknown
  Synthetic Peptide
KEKLQEQQSDSEQER

SEQ ID NO: 3326 - protein, 15 aa, Unknown
  Synthetic Peptide
KETLQGQQSDLEQER

SEQ ID NO: 3327 - protein, 15 aa, Unknown
  Synthetic Peptide
KSLLRNLGVSENIFL

SEQ ID NO: 3328 - protein, 15 aa, Unknown
  Synthetic Peptide
KSNLRSGSSNSRNRI

SEQ ID NO: 3329 - protein, 15 aa, Unknown
  Synthetic Peptide
DKELTMSNVKNVSQT

SEQ ID NO: 3330 - protein, 15 aa, Unknown
  Synthetic Peptide
YFILVNLLIFHINGK

SEQ ID NO: 3331 - protein, 15 aa, Unknown
  Synthetic Peptide
KKHVLSHNSYEKTKN

SEQ ID NO: 3332 - protein, 15 aa, Unknown
  Synthetic Peptide
ISDVNDFQISKYEDE

SEQ ID NO: 3333 - protein, 15 aa, Unknown
  Synthetic Peptide
LETVNISDVNDFQIS

SEQ ID NO: 3334 - protein, 15 aa, Unknown
  Synthetic Peptide
SAEYDDSLIDEEEDD

SEQ ID NO: 3335 - protein, 15 aa, Unknown
  Synthetic Peptide
EDLYGRLEIPAIELP

SEQ ID NO: 3336 - protein, 15 aa, Unknown
  Synthetic Peptide
RGYYIPHQSSLPQDN

SEQ ID NO: 3337 - protein, 15 aa, Unknown
  Synthetic Peptide
RHPFKIGSSDPADNA

SEQ ID NO: 3338 - protein, 15 aa, Unknown
  Synthetic Peptide
EPLIDVHDLISDMIK

SEQ ID NO: 3339 - protein, 15 aa, Unknown
  Synthetic Peptide
FFIIFNKESLAEKTN

SEQ ID NO: 3340 - protein, 15 aa, Unknown
  Synthetic Peptide
PFKIGSSDPADNANP

SEQ ID NO: 3341 - protein, 15 aa, Unknown
  Synthetic Peptide
VFFLALFFIIFNKES

SEQ ID NO: 3342 - protein, 15 aa, Unknown
  Synthetic Peptide
KYKLATSVLAGLLGN

SEQ ID NO: 3343 - protein, 15 aa, Unknown
  Synthetic Peptide
TVLLGGVGLVLYNTE

SEQ ID NO: 3344 - protein, 15 aa, Unknown
  Synthetic Peptide
AGLLGNVSTVLLGGV

SEQ ID NO: 3345 - protein, 15 aa, Unknown
  Synthetic Peptide
LAGLLGNVSTVLLGG

SEQ ID NO: 3346 - protein, 15 aa, Unknown
  Synthetic Peptide
MKILSVFFLALFFII

SEQ ID NO: 3347 - protein, 15 aa, Unknown
  Synthetic Peptide
GVGLVLYNTEKGRHP

SEQ ID NO: 3348 - protein, 15 aa, Unknown
  Synthetic Peptide
ILSVFFLALFFIIFN

SEQ ID NO: 3349 - protein, 15 aa, Unknown
  Synthetic Peptide
LIDVHDLISDMIKKE

SEQ ID NO: 3350 - protein, 15 aa, Unknown
  Synthetic Peptide
ATSVLAGLLGNVSTV

SEQ ID NO: 3351 - protein, 15 aa, Unknown
  Synthetic Peptide
VSTVLLGGVGLVLYN

SEQ ID NO: 3352 - protein, 15 aa, Unknown
  Synthetic Peptide
LVEVNKRKSKYKLAT

SEQ ID NO: 3353 - protein, 15 aa, Unknown
  Synthetic Peptide
LGNVSTVLLGGVGLV

SEQ ID NO: 3354 - protein, 15 aa, Unknown
  Synthetic Peptide
KSKYKLATSVLAGLL

SEQ ID NO: 3355 - protein, 15 aa, Unknown
  Synthetic Peptide
LIFFDLFLVNGRDVQ

SEQ ID NO: 3356 - protein, 15 aa, Unknown
  Synthetic Peptide
FLIFFDLFLVNGRDV

SEQ ID NO: 3357 - protein, 15 aa, Unknown
  Synthetic Peptide
IGPFMKAVCVEVEKT

SEQ ID NO: 3358 - protein, 15 aa, Unknown
  Synthetic Peptide
NVAFNRFLVGCHPSD

SEQ ID NO: 3359 - protein, 15 aa, Unknown
  Synthetic Peptide
AGGIAGGLALLACAG

SEQ ID NO: 3360 - protein, 15 aa, Unknown
  Synthetic Peptide
GVKIAVFGIGQGINV

SEQ ID NO: 3361 - protein, 15 aa, Unknown
  Synthetic Peptide
LALLACAGLAYKFVV

SEQ ID NO: 3362 - protein, 15 aa, Unknown
  Synthetic Peptide
AGGLALLACAGLAYK

SEQ ID NO: 3363 - protein, 15 aa, Unknown
  Synthetic Peptide
AVPLAMKLIQQLNLN

SEQ ID NO: 3364 - protein, 15 aa, Unknown
  Synthetic Peptide
CAGLAYKFVVPGAAT

SEQ ID NO: 3365 - protein, 15 aa, Unknown
  Synthetic Peptide
IVFLIFFDLFLVNGR

SEQ ID NO: 3366 - protein, 15 aa, Unknown
  Synthetic Peptide
VVILTDGIPDSIQDS

SEQ ID NO: 3367 - protein, 15 aa, Unknown
  Synthetic Peptide
NRFLVGCHPSDGKCN

SEQ ID NO: 3368 - protein, 15 aa, Unknown
  Synthetic Peptide
VKYLVIVFLIFFDLF

SEQ ID NO: 3369 - protein, 15 aa, Unknown
  Synthetic Peptide
ANQLVVILTDGIPDS

SEQ ID NO: 3370 - protein, 15 aa, Unknown
  Synthetic Peptide
YLLMDCSGSIRRHNW

SEQ ID NO: 3371 - protein, 15 aa, Unknown
  Synthetic Peptide
GPFMKAVCVEVEKTA

SEQ ID NO: 3372 - protein, 15 aa, Unknown
  Synthetic Peptide
CVEVEKTASCGVWDE

SEQ ID NO: 3373 - protein, 15 aa, Unknown
  Synthetic Peptide
RFLVGCHPSDGKCNL

SEQ ID NO: 3374 - protein, 15 aa, Unknown
  Synthetic Peptide
VKNVIGPFMKAVCVE

SEQ ID NO: 3375 - protein, 15 aa, Unknown
  Synthetic Peptide
KYLVIVFLIFFDLFL

SEQ ID NO: 3376 - protein, 15 aa, Unknown
  Synthetic Peptide
LGNVKYLVIVFLIFF

SEQ ID NO: 3377 - protein, 15 aa, Unknown
  Synthetic Peptide
LFLVNGRDVQNNIVD

SEQ ID NO: 3378 - protein, 15 aa, Unknown
  Synthetic Peptide
CGVWDEWSPCSVTCG

SEQ ID NO: 3379 - protein, 15 aa, Unknown
  Synthetic Peptide
KYKIAGGIAGGLALL

SEQ ID NO: 3380 - protein, 15 aa, Unknown
  Synthetic Peptide
GRDVQNNIVDEIKYR

SEQ ID NO: 3381 - protein, 15 aa, Unknown
  Synthetic Peptide
VDLYLLMDCSGSIRR

SEQ ID NO: 3382 - protein, 15 aa, Unknown
  Synthetic Peptide
AYKFVVPGAATPYAG

SEQ ID NO: 3383 - protein, 15 aa, Unknown
  Synthetic Peptide
GLAYKFVVPGAATPY

SEQ ID NO: 3384 - protein, 15 aa, Unknown
  Synthetic Peptide
AKEIIRLHSDASKNK

SEQ ID NO: 3385 - protein, 15 aa, Unknown
  Synthetic Peptide
EENIIDNNPQEPSPN

SEQ ID NO: 3386 - protein, 15 aa, Unknown
  Synthetic Peptide
NDEVDLYLLMDCSGS

SEQ ID NO: 3387 - protein, 15 aa, Unknown
  Synthetic Peptide
IKSLLSTNLPYGRTN

SEQ ID NO: 3388 - protein, 15 aa, Unknown
  Synthetic Peptide
REILHEGCTSELQEQ

SEQ ID NO: 3389 - protein, 15 aa, Unknown
  Synthetic Peptide
HNWVNHAVPLAMKLI

SEQ ID NO: 3390 - protein, 15 aa, Unknown
  Synthetic Peptide
KFVVPGAATPYAGEP

SEQ ID NO: 3391 - protein, 15 aa, Unknown
  Synthetic Peptide
YKFVVPGAATPYAGE

SEQ ID NO: 3392 - protein, 15 aa, Unknown
  Synthetic Peptide
RHNWVNHAVPLAMKL

SEQ ID NO: 3393 - protein, 15 aa, Unknown
  Synthetic Peptide
KSLLSTNLPYGRTNL

SEQ ID NO: 3394 - protein, 9 aa, Unknown
  Synthetic Peptide
LFQEYQCYG

SEQ ID NO: 3395 - protein, 9 aa, Unknown
  Synthetic Peptide
LFVEALFQE

SEQ ID NO: 3396 - protein, 9 aa, Unknown
  Synthetic Peptide
MPNDPNRNV

SEQ ID NO: 3397 - protein, 9 aa, Unknown
  Synthetic Peptide
LYNELEMNY

SEQ ID NO: 3398 - protein, 9 aa, Unknown
  Synthetic Peptide
VLNELNYDN

SEQ ID NO: 3399 - protein, 9 aa, Unknown
  Synthetic Peptide
YENDIEKKI

SEQ ID NO: 3400 - protein, 9 aa, Unknown
  Synthetic Peptide
LNYDNAGIN

SEQ ID NO: 3401 - protein, 9 aa, Unknown
  Synthetic Peptide
LSTEWSPCS

SEQ ID NO: 3402 - protein, 9 aa, Unknown
  Synthetic Peptide
LDYENDIEK

SEQ ID NO: 3403 - protein, 9 aa, Unknown
  Synthetic Peptide
FDGDNEILQ

SEQ ID NO: 3404 - protein, 9 aa, Unknown
  Synthetic Peptide
FDKDKELTM

SEQ ID NO: 3405 - protein, 9 aa, Unknown
  Synthetic Peptide
FQDEENIGI

SEQ ID NO: 3406 - protein, 9 aa, Unknown
  Synthetic Peptide
IDEEEDDED

SEQ ID NO: 3407 - protein, 9 aa, Unknown
  Synthetic Peptide
IINDDDDKK

SEQ ID NO: 3408 - protein, 9 aa, Unknown
  Synthetic Peptide
INDDDDKKK

SEQ ID NO: 3409 - protein, 9 aa, Unknown
  Synthetic Peptide
ISAEYDDSL

SEQ ID NO: 3410 - protein, 9 aa, Unknown
  Synthetic Peptide
IVDELSEDI

SEQ ID NO: 3411 - protein, 9 aa, Unknown
  Synthetic Peptide
IYKELEDLI

SEQ ID NO: 3412 - protein, 9 aa, Unknown
  Synthetic Peptide
LAEDLYGRL

SEQ ID NO: 3413 - protein, 9 aa, Unknown
  Synthetic Peptide
LAKEKLQEQ

SEQ ID NO: 3414 - protein, 9 aa, Unknown
  Synthetic Peptide
LAKEKLQGQ

SEQ ID NO: 3415 - protein, 9 aa, Unknown
  Synthetic Peptide
LANEKLQEQ

SEQ ID NO: 3416 - protein, 9 aa, Unknown
  Synthetic Peptide
LEQDRLAKE

SEQ ID NO: 3417 - protein, 9 aa, Unknown
  Synthetic Peptide
LEQERLAKE

SEQ ID NO: 3418 - protein, 9 aa, Unknown
  Synthetic Peptide
LEQERLANE

SEQ ID NO: 3419 - protein, 9 aa, Unknown
  Synthetic Peptide
LIDEEEDDE

SEQ ID NO: 3420 - protein, 9 aa, Unknown
  Synthetic Peptide
LPSENERGY

SEQ ID NO: 3421 - protein, 9 aa, Unknown
  Synthetic Peptide
LSEDITKYF

SEQ ID NO: 3422 - protein, 9 aa, Unknown
  Synthetic Peptide
LSEEKIKKG

SEQ ID NO: 3423 - protein, 9 aa, Unknown
  Synthetic Peptide
LYDEHIKKY

SEQ ID NO: 3424 - protein, 9 aa, Unknown
  Synthetic Peptide
VLAEDLYGR

SEQ ID NO: 3425 - protein, 9 aa, Unknown
  Synthetic Peptide
VNKEKEKFI

SEQ ID NO: 3426 - protein, 9 aa, Unknown
  Synthetic Peptide
VQYDNFQDE

SEQ ID NO: 3427 - protein, 9 aa, Unknown
  Synthetic Peptide
YEDEISAEY

SEQ ID NO: 3428 - protein, 9 aa, Unknown
  Synthetic Peptide
YKNDKQVNK

SEQ ID NO: 3429 - protein, 9 aa, Unknown
  Synthetic Peptide
FNKESLAEK

SEQ ID NO: 3430 - protein, 9 aa, Unknown
  Synthetic Peptide
IKKEEELVE

SEQ ID NO: 3431 - protein, 9 aa, Unknown
  Synthetic Peptide
LISDMIKKE

SEQ ID NO: 3432 - protein, 9 aa, Unknown
  Synthetic Peptide
VTPEQPQGD

SEQ ID NO: 3433 - protein, 9 aa, Unknown
  Synthetic Peptide
YNTEKGRHP

SEQ ID NO: 3434 - protein, 9 aa, Unknown
  Synthetic Peptide
IFFDLFLVN

SEQ ID NO: 3435 - protein, 9 aa, Unknown
  Synthetic Peptide
ILTDGIPDS

SEQ ID NO: 3436 - protein, 9 aa, Unknown
  Synthetic Peptide
INRENANQL

SEQ ID NO: 3437 - protein, 9 aa, Unknown
  Synthetic Peptide
LHSDASKNK

SEQ ID NO: 3438 - protein, 9 aa, Unknown
  Synthetic Peptide
LYADSAWEN

SEQ ID NO: 3439 - protein, 9 aa, Unknown
  Synthetic Peptide
VCVEVEKTA

SEQ ID NO: 3440 - protein, 9 aa, Unknown
  Synthetic Peptide
VEVEKTASC

SEQ ID NO: 3441 - protein, 9 aa, Unknown
  Synthetic Peptide
VPSDVPKNP

SEQ ID NO: 3442 - protein, 9 aa, Unknown
  Synthetic Peptide
VWDEWSPCS

SEQ ID NO: 3443 - protein, 9 aa, Unknown
  Synthetic Peptide
LLMDCSGSI

SEQ ID NO: 3444 - protein, 9 aa, Unknown
  Synthetic Peptide
ILHEGCTSE

SEQ ID NO: 3445 - protein, 9 aa, Unknown
  Synthetic Peptide
IPEDSEKEV

SEQ ID NO: 3446 - protein, 9 aa, Unknown
  Synthetic Peptide
YREEVCNDE

SEQ ID NO: 3447 - protein, 9 aa, Unknown
  Synthetic Peptide
VCNDEVDLY

SEQ ID NO: 3448 - protein, 9 aa, Unknown
  Synthetic Peptide
YAGEPAPFD

SEQ ID NO: 3449 - protein, 15 aa, Unknown
  Synthetic Peptide
VEALFQEYQCYGSSS

SEQ ID NO: 3450 - protein, 15 aa, Unknown
  Synthetic Peptide
SSFLFVEALFQEYQC

SEQ ID NO: 3451 - protein, 15 aa, Unknown
  Synthetic Peptide
GHNMPNDPNRNVDEN

SEQ ID NO: 3452 - protein, 15 aa, Unknown
  Synthetic Peptide
GINLYNELEMNYYGK

SEQ ID NO: 3453 - protein, 15 aa, Unknown
  Synthetic Peptide
NTRVLNELNYDNAGI

SEQ ID NO: 3454 - protein, 15 aa, Unknown
  Synthetic Peptide
ELDYENDIEKKICKM

SEQ ID NO: 3455 - protein, 15 aa, Unknown
  Synthetic Peptide
LNELNYDNAGINLYN

SEQ ID NO: 3456 - protein, 15 aa, Unknown
  Synthetic Peptide
QNSLSTEWSPCSVTC

SEQ ID NO: 3457 - protein, 15 aa, Unknown
  Synthetic Peptide
KDELDYENDIEKKIC

SEQ ID NO: 3458 - protein, 15 aa, Unknown
  Synthetic Peptide
FHIFDGDNEILQIVD

SEQ ID NO: 3459 - protein, 15 aa, Unknown
  Synthetic Peptide
NKFFDKDKELTMSNV

SEQ ID NO: 3460 - protein, 15 aa, Unknown
  Synthetic Peptide
YDNFQDEENIGIYKE

SEQ ID NO: 3461 - protein, 15 aa, Unknown
  Synthetic Peptide
DSLIDEEEDDEDLDE

SEQ ID NO: 3462 - protein, 15 aa, Unknown
  Synthetic Peptide
IEHIINDDDDKKKYI

SEQ ID NO: 3463 - protein, 15 aa, Unknown
  Synthetic Peptide
EHIINDDDDKKKYIK

SEQ ID NO: 3464 - protein, 15 aa, Unknown
  Synthetic Peptide
EDEISAEYDDSLIDE

SEQ ID NO: 3465 - protein, 15 aa, Unknown
  Synthetic Peptide
ILQIVDELSEDITKY

SEQ ID NO: 3466 - protein, 15 aa, Unknown
  Synthetic Peptide
NIGIYKELEDLIEKN

SEQ ID NO: 3467 - protein, 15 aa, Unknown
  Synthetic Peptide
GDVLAEDLYGRLEIP

SEQ ID NO: 3468 - protein, 15 aa, Unknown
  Synthetic Peptide
QERLAKEKLQEQQSD

SEQ ID NO: 3469 - protein, 15 aa, Unknown
  Synthetic Peptide
QERLAKEKLQGQQSD

SEQ ID NO: 3470 - protein, 15 aa, Unknown
  Synthetic Peptide
QERLANEKLQEQQRD

SEQ ID NO: 3471 - protein, 15 aa, Unknown
  Synthetic Peptide
QSDLEQDRLAKEKLQ

SEQ ID NO: 3472 - protein, 15 aa, Unknown
  Synthetic Peptide
QSDLEQERLAKEKLQ

SEQ ID NO: 3473 - protein, 15 aa, Unknown
  Synthetic Peptide
QSDLEQERLANEKLQ

SEQ ID NO: 3474 - protein, 15 aa, Unknown
  Synthetic Peptide
DDSLIDEEEDDEDLD

SEQ ID NO: 3475 - protein, 15 aa, Unknown
  Synthetic Peptide
AIELPSENERGYYIP

SEQ ID NO: 3476 - protein, 15 aa, Unknown
  Synthetic Peptide
VDELSEDITKYFMKL

SEQ ID NO: 3477 - protein, 15 aa, Unknown
  Synthetic Peptide
SEELSEEKIKKGKKY

SEQ ID NO: 3478 - protein, 15 aa, Unknown
  Synthetic Peptide
DKSLYDEHIKKYKND

SEQ ID NO: 3479 - protein, 15 aa, Unknown
  Synthetic Peptide
HGDVLAEDLYGRLEI

SEQ ID NO: 3480 - protein, 15 aa, Unknown
  Synthetic Peptide
DKQVNKEKEKFIKSL

SEQ ID NO: 3481 - protein, 15 aa, Unknown
  Synthetic Peptide
KPIVQYDNFQDEENI

SEQ ID NO: 3482 - protein, 15 aa, Unknown
  Synthetic Peptide
ISKYEDEISAEYDDS

SEQ ID NO: 3483 - protein, 15 aa, Unknown
  Synthetic Peptide
IKKYKNDKQVNKEKE

SEQ ID NO: 3484 - protein, 15 aa, Unknown
  Synthetic Peptide
FIIFNKESLAEKTNK

SEQ ID NO: 3485 - protein, 15 aa, Unknown
  Synthetic Peptide
SDMIKKEEELVEVNK

SEQ ID NO: 3486 - protein, 15 aa, Unknown
  Synthetic Peptide
VHDLISDMIKKEEEL

SEQ ID NO: 3487 - protein, 15 aa, Unknown
  Synthetic Peptide
AQDVTPEQPQGDDNN

SEQ ID NO: 3488 - protein, 15 aa, Unknown
  Synthetic Peptide
LVLYNTEKGRHPFKI

SEQ ID NO: 3489 - protein, 15 aa, Unknown
  Synthetic Peptide
VFLIFFDLFLVNGRD

SEQ ID NO: 3490 - protein, 15 aa, Unknown
  Synthetic Peptide
LVVILTDGIPDSIQD

SEQ ID NO: 3491 - protein, 15 aa, Unknown
  Synthetic Peptide
NDRINRENANQLVVI

SEQ ID NO: 3492 - protein, 15 aa, Unknown
  Synthetic Peptide
IIRLHSDASKNKEKA

SEQ ID NO: 3493 - protein, 15 aa, Unknown
  Synthetic Peptide
KCNLYADSAWENVKN

SEQ ID NO: 3494 - protein, 15 aa, Unknown
  Synthetic Peptide
MKAVCVEVEKTASCG

SEQ ID NO: 3495 - protein, 15 aa, Unknown
  Synthetic Peptide
AVCVEVEKTASCGVW

SEQ ID NO: 3496 - protein, 15 aa, Unknown
  Synthetic Peptide
EKEVPSDVPKNPEDD

SEQ ID NO: 3497 - protein, 15 aa, Unknown
  Synthetic Peptide
SCGVWDEWSPCSVTC

SEQ ID NO: 3498 - protein, 15 aa, Unknown
  Synthetic Peptide
DLYLLMDCSGSIRRH

SEQ ID NO: 3499 - protein, 15 aa, Unknown
  Synthetic Peptide
KREILHEGCTSELQE

SEQ ID NO: 3500 - protein, 15 aa, Unknown
  Synthetic Peptide
EPNIPEDSEKEVPSD

SEQ ID NO: 3501 - protein, 15 aa, Unknown
  Synthetic Peptide
EIKYREEVCNDEVDL

SEQ ID NO: 3502 - protein, 15 aa, Unknown
  Synthetic Peptide
REEVCNDEVDLYLLM

SEQ ID NO: 3503 - protein, 15 aa, Unknown
  Synthetic Peptide
ATPYAGEPAPFDETL

SEQ ID NO: 3504 - protein, 9 aa, Unknown
  Synthetic Peptide
LKKNSRSLG

SEQ ID NO: 3505 - protein, 9 aa, Unknown
  Synthetic Peptide
ANNDVKNNN

SEQ ID NO: 3506 - protein, 9 aa, Unknown
  Synthetic Peptide
ADIQNHTLE

SEQ ID NO: 3507 - protein, 9 aa, Unknown
  Synthetic Peptide
FHINGKIIK

SEQ ID NO: 3508 - protein, 9 aa, Unknown
  Synthetic Peptide
FKPNDKSLY

SEQ ID NO: 3509 - protein, 9 aa, Unknown
  Synthetic Peptide
FLKENKLNK

SEQ ID NO: 3510 - protein, 9 aa, Unknown
  Synthetic Peptide
IEKTNRESI

SEQ ID NO: 3511 - protein, 9 aa, Unknown
  Synthetic Peptide
IKNSEKDEI

SEQ ID NO: 3512 - protein, 9 aa, Unknown
  Synthetic Peptide
IKPEQKEDK

SEQ ID NO: 3513 - protein, 9 aa, Unknown
  Synthetic Peptide
IKSNLRSGS

SEQ ID NO: 3514 - protein, 9 aa, Unknown
  Synthetic Peptide
INEEKHEKK

SEQ ID NO: 3515 - protein, 9 aa, Unknown
  Synthetic Peptide
LEQERRAKE

SEQ ID NO: 3516 - protein, 9 aa, Unknown
  Synthetic Peptide
LNKEGKLIE

SEQ ID NO: 3517 - protein, 9 aa, Unknown
  Synthetic Peptide
LPQDNRGNS

SEQ ID NO: 3518 - protein, 9 aa, Unknown
  Synthetic Peptide
LQEQQRDLE

SEQ ID NO: 3519 - protein, 9 aa, Unknown
  Synthetic Peptide
AEKTNKGTG

SEQ ID NO: 3520 - protein, 9 aa, Unknown
  Synthetic Peptide
LYNTEKGRH

SEQ ID NO: 3521 - protein, 9 aa, Unknown
  Synthetic Peptide
VEVNKRKSK

SEQ ID NO: 3522 - protein, 9 aa, Unknown
  Synthetic Peptide
AWENVKNVI

SEQ ID NO: 3523 - protein, 9 aa, Unknown
  Synthetic Peptide
FLVNGRDVQ

SEQ ID NO: 3524 - protein, 9 aa, Unknown
  Synthetic Peptide
LGEEDKDLD

SEQ ID NO: 3525 - protein, 9 aa, Unknown
  Synthetic Peptide
LDNERKQSD

SEQ ID NO: 3526 - protein, 9 aa, Unknown
  Synthetic Peptide
VLDNERKQS

SEQ ID NO: 3527 - protein, 9 aa, Unknown
  Synthetic Peptide
IQDSLKESR

SEQ ID NO: 3528 - protein, 9 aa, Unknown
  Synthetic Peptide
IVDEIKYRE

SEQ ID NO: 3529 - protein, 9 aa, Unknown
  Synthetic Peptide
ALLQVRKHL

SEQ ID NO: 3530 - protein, 9 aa, Unknown
  Synthetic Peptide
LKESRKLND

SEQ ID NO: 3531 - protein, 9 aa, Unknown
  Synthetic Peptide
FSNNAKEII

SEQ ID NO: 3532 - protein, 9 aa, Unknown
  Synthetic Peptide
YNDTPKHPE

SEQ ID NO: 3533 - protein, 9 aa, Unknown
  Synthetic Peptide
FSNNAREII

SEQ ID NO: 3534 - protein, 9 aa, Unknown
  Synthetic Peptide
LKESRKLSD

SEQ ID NO: 3535 - protein, 9 aa, Unknown
  Synthetic Peptide
YNDTPKYPE

SEQ ID NO: 3536 - protein, 9 aa, Unknown
  Synthetic Peptide
AGSDNKYKI

SEQ ID NO: 3537 - protein, 9 aa, Unknown
  Synthetic Peptide
ALLEVRKHL

SEQ ID NO: 3538 - protein, 9 aa, Unknown
  Synthetic Peptide
IVDEIKYSE

SEQ ID NO: 3539 - protein, 15 aa, Unknown
  Synthetic Peptide
WYSLKKNSRSLGEND

SEQ ID NO: 3540 - protein, 15 aa, Unknown
  Synthetic Peptide
NANANNDVKNNNNEE

SEQ ID NO: 3541 - protein, 15 aa, Unknown
  Synthetic Peptide
DKSADIQNHTLETVN

SEQ ID NO: 3542 - protein, 15 aa, Unknown
  Synthetic Peptide
LLIFHINGKIIKNSE

SEQ ID NO: 3543 - protein, 15 aa, Unknown
  Synthetic Peptide
DNNFKPNDKSLYDEH

SEQ ID NO: 3544 - protein, 15 aa, Unknown
  Synthetic Peptide
ENIFLKENKLNKEGK

SEQ ID NO: 3545 - protein, 15 aa, Unknown
  Synthetic Peptide
ISIIEKTNRESITTN

SEQ ID NO: 3546 - protein, 15 aa, Unknown
  Synthetic Peptide
GKIIKNSEKDEIIKS

SEQ ID NO: 3547 - protein, 15 aa, Unknown
  Synthetic Peptide
DGSIKPEQKEDKSAD

SEQ ID NO: 3548 - protein, 15 aa, Unknown
  Synthetic Peptide
DEIIKSNLRSGSSNS

SEQ ID NO: 3549 - protein, 15 aa, Unknown
  Synthetic Peptide
RNRINEEKHEKKHVL

SEQ ID NO: 3550 - protein, 15 aa, Unknown
  Synthetic Peptide
QSDLEQERRAKEKLQ

SEQ ID NO: 3551 - protein, 15 aa, Unknown
  Synthetic Peptide
ENKLNKEGKLIEHII

SEQ ID NO: 3552 - protein, 15 aa, Unknown
  Synthetic Peptide
QSSLPQDNRGNSRDS

SEQ ID NO: 3553 - protein, 15 aa, Unknown
  Synthetic Peptide
NEKLQEQQRDLEQER

SEQ ID NO: 3554 - protein, 15 aa, Unknown
  Synthetic Peptide
ESLAEKTNKGTGSGV

SEQ ID NO: 3555 - protein, 15 aa, Unknown
  Synthetic Peptide
GLVLYNTEKGRHPFK

SEQ ID NO: 3556 - protein, 15 aa, Unknown
  Synthetic Peptide
EELVEVNKRKSKYKL

SEQ ID NO: 3557 - protein, 15 aa, Unknown
  Synthetic Peptide
ADSAWENVKNVIGPF

SEQ ID NO: 3558 - protein, 15 aa, Unknown
  Synthetic Peptide
FDLFLVNGRDVQNNI

SEQ ID NO: 3559 - protein, 15 aa, Unknown
  Synthetic Peptide
DETLGEEDKDLDEPE

SEQ ID NO: 3560 - protein, 15 aa, Unknown
  Synthetic Peptide
PKVLDNERKQSDPQS

SEQ ID NO: 3561 - protein, 15 aa, Unknown
  Synthetic Peptide
PPKVLDNERKQSDPQ

SEQ ID NO: 3562 - protein, 15 aa, Unknown
  Synthetic Peptide
PDSIQDSLKESRKLN

SEQ ID NO: 3563 - protein, 15 aa, Unknown
  Synthetic Peptide
QNNIVDEIKYREEVC

SEQ ID NO: 3564 - protein, 15 aa, Unknown
  Synthetic Peptide
LTDALLQVRKHLNDR

SEQ ID NO: 3565 - protein, 15 aa, Unknown
  Synthetic Peptide
QDSLKESRKLNDRGV

SEQ ID NO: 3566 - protein, 15 aa, Unknown
  Synthetic Peptide
VNVFSNNAKEIIRLH

SEQ ID NO: 3567 - protein, 15 aa, Unknown
  Synthetic Peptide
NRKYNDTPKHPEREE

SEQ ID NO: 3568 - protein, 15 aa, Unknown
  Synthetic Peptide
LNIFSNNAREIIRLH

SEQ ID NO: 3569 - protein, 15 aa, Unknown
  Synthetic Peptide
QDSLKESRKLSDRGV

SEQ ID NO: 3570 - protein, 15 aa, Unknown
  Synthetic Peptide
NRKYNDTPKYPEREE

SEQ ID NO: 3571 - protein, 15 aa, Unknown
  Synthetic Peptide
KKKAGSDNKYKIAGG

SEQ ID NO: 3572 - protein, 15 aa, Unknown
  Synthetic Peptide
LTDALLEVRKHLNDR

SEQ ID NO: 3573 - protein, 15 aa, Unknown
  Synthetic Peptide
QNNIVDEIKYSEEVC

SEQ ID NO: 3574 - protein, 15 aa, Unknown
  Synthetic Peptide
DPQVTAQDVTPEQPQ

SEQ ID NO: 3575 - protein, 9 aa, Unknown
  Synthetic Peptide
YLEPAIAKY

SEQ ID NO: 3576 - protein, 10 aa, Unknown
  Synthetic Peptide
FLPSDYFPSV

SEQ ID NO: 3577 - protein, 10 aa, Unknown
  Synthetic Peptide
FLPSDYFPSV

SEQ ID NO: 3578 - protein, 10 aa, Unknown
  Synthetic Peptide
FLPSDYFPSV

SEQ ID NO: 3579 - protein, 10 aa, Unknown
  Synthetic Peptide
FLPSDYFPSV

SEQ ID NO: 3580 - protein, 10 aa, Unknown
  Synthetic Peptide
FLPSDYFPSV

SEQ ID NO: 3581 - protein, 10 aa, Unknown
  Synthetic Peptide
FLPSDYFPSV

SEQ ID NO: 3582 - protein, 9 aa, Unknown
  Synthetic Peptide
FTQAGYPAL

SEQ ID NO: 3583 - protein, 10 aa, Unknown
  Synthetic Peptide
KVFPYALINK

SEQ ID NO: 3584 - protein, 9 aa, Unknown
  Synthetic Peptide
AVDLYHFLK

SEQ ID NO: 3585 - protein, 10 aa, Unknown
  Synthetic Peptide
KVFPYALINK

SEQ ID NO: 3586 - protein, 11 aa, Unknown
  Synthetic Peptide
STLPETYVVRR

SEQ ID NO: 3587 - protein, 10 aa, Unknown
  Synthetic Peptide
KVFPYALINK

SEQ ID NO: 3588 - protein, 9 aa, Unknown
  Synthetic Peptide
AYIDNYNKF

SEQ ID NO: 3589 - protein, 9 aa, Unknown
  Synthetic Peptide
APRTLVYLL

SEQ ID NO: 3590 - protein, 9 aa, Unknown
  Synthetic Peptide
FPFKYAAAF

SEQ ID NO: 3591 - protein, 9 aa, Unknown
  Synthetic Peptide
FPFKYAAAF

SEQ ID NO: 3592 - protein, 9 aa, Unknown
  Synthetic Peptide
FPFKYAAAF

SEQ ID NO: 3593 - protein, 9 aa, Unknown
  Synthetic Peptide
FPFKYAAAF

SEQ ID NO: 3594 - protein, 13 aa, Unknown
  Synthetic Peptide
PKYVKQNTLKLAT

SEQ ID NO: 3595 - protein, 12 aa, Unknown
  Synthetic Peptide
YKTIAFDEEARR

SEQ ID NO: 3596 - protein, 13 aa, Unknown
  Synthetic Peptide
PKYVKQNTLKLAT

SEQ ID NO: 3597 - protein, 14 aa, Unknown
  Synthetic Peptide
YARFQSQTTLKQKT

SEQ ID NO: 3598 - protein, 14 aa, Unknown
  Synthetic Peptide
YARFQSQTTLKQKT

SEQ ID NO: 3599 - protein, 14 aa, Unknown
  Synthetic Peptide
QYIKANSKFIGITE

SEQ ID NO: 3600 - protein, 14 aa, Unknown
  Synthetic Peptide
QYIKANSKFIGITE

SEQ ID NO: 3601 - protein, 14 aa, Unknown
  Synthetic Peptide
QYIKANSKFIGITE

SEQ ID NO: 3602 - protein, 14 aa, Unknown
  Synthetic Peptide
QYIKANSKFIGITE

SEQ ID NO: 3603 - protein, 14 aa, Unknown
  Synthetic Peptide
QYIKANSKFIGITE

SEQ ID NO: 3604 - protein, 15 aa, Unknown
  Synthetic Peptide
EALIHQLKINPYVLS

SEQ ID NO: 3605 - protein, 14 aa, Unknown
  Synthetic Peptide
QYIKANAKFIGITE

SEQ ID NO: 3606 - protein, 24 aa, Unknown
  Synthetic Peptide
GRTQDENPVVHFFKNIVTPRTPPP

SEQ ID NO: 3607 - protein, 13 aa, Unknown
  Synthetic Peptide
NGQIGNDPNRDIL

SEQ ID NO: 3608 - protein, 14 aa, Unknown
  Synthetic Peptide
YARFQSQTTLKQKT

SEQ ID NO: 3609 - protein, 14 aa, Unknown
  Synthetic Peptide
QYIKANSKFIGITE

SEQ ID NO: 3610 - protein, 10 aa, Unknown
  Synthetic Peptide
FLIFFDLFLV

SEQ ID NO: 3611 - protein, 9 aa, Unknown
  Synthetic Peptide
FMKAVCVEV

SEQ ID NO: 3612 - protein, 9 aa, Unknown
  Synthetic Peptide
GLIMVLSFL

SEQ ID NO: 3613 - protein, 9 aa, Unknown
  Synthetic Peptide
VLAGLLGNV

SEQ ID NO: 3614 - protein, 9 aa, Unknown
  Synthetic Peptide
KILSVFFLA

SEQ ID NO: 3615 - protein, 9 aa, Unknown
  Synthetic Peptide
GLLGNVSTV

SEQ ID NO: 3616 - protein, 10 aa, Unknown
  Synthetic Peptide
ILSVSSFLFV

SEQ ID NO: 3617 - protein, 10 aa, Unknown
  Synthetic Peptide
VLLGGVGLVL

SEQ ID NO: 3618 - protein, 9 aa, Unknown
  Synthetic Peptide
LACAGLAYK

SEQ ID NO: 3619 - protein, 9 aa, Unknown
  Synthetic Peptide
QTNFKSLLR

SEQ ID NO: 3620 - protein, 10 aa, Unknown
  Synthetic Peptide
VTCGNGIQVR

SEQ ID NO: 3621 - protein, 9 aa, Unknown
  Synthetic Peptide
ALFFIIFNK

SEQ ID NO: 3622 - protein, 9 aa, Unknown
  Synthetic Peptide
GVSENIFLK

SEQ ID NO: 3623 - protein, 10 aa, Unknown
  Synthetic Peptide
HVLSHNSYEK

SEQ ID NO: 3624 - protein, 10 aa, Unknown
  Synthetic Peptide
LLACAGLAYK

SEQ ID NO: 3625 - protein, 10 aa, Unknown
  Synthetic Peptide
FILVNLLIFH

SEQ ID NO: 3626 - protein, 10 aa, Unknown
  Synthetic Peptide
TPYAGEPAPF

SEQ ID NO: 3627 - protein, 8 aa, Unknown
  Synthetic Peptide
LPYGRTNL

SEQ ID NO: 3628 - protein, 10 aa, Unknown
  Synthetic Peptide
FQDEENIGIY

SEQ ID NO: 3629 - protein, 9 aa, Unknown
  Synthetic Peptide
FVEALFQEY

SEQ ID NO: 3630 - protein, 9 aa, Unknown
  Synthetic Peptide
LPSENERGY

SEQ ID NO: 3631 - protein, 9 aa, Unknown
  Synthetic Peptide
PSDGKCNLY

SEQ ID NO: 3632 - protein, 9 aa, Unknown
  Synthetic Peptide
FYFILVNLL

SEQ ID NO: 3633 - protein, 9 aa, Unknown
  Synthetic Peptide
KYKLATSVL

SEQ ID NO: 3634 - protein, 9 aa, Unknown
  Synthetic Peptide
KYLVIVFLI

SEQ ID NO: 3635 - protein, 9 aa, Unknown
  Synthetic Peptide
YYIPHQSSL

SEQ ID NO: 3636 - protein, 9 aa, Unknown
  Synthetic Peptide
GLIMVLSFL

SEQ ID NO: 3637 - protein, 10 aa, Unknown
  Synthetic Peptide
ILSVSSFLFV

SEQ ID NO: 3638 - protein, 9 aa, Unknown
  Synthetic Peptide
VLAGLLGNV

SEQ ID NO: 3639 - protein, 9 aa, Unknown
  Synthetic Peptide
KILSVFFLA

SEQ ID NO: 3640 - protein, 9 aa, Unknown
  Synthetic Peptide
GLLGNVSTV

SEQ ID NO: 3641 - protein, 10 aa, Unknown
  Synthetic Peptide
VLLGGVGLVL

SEQ ID NO: 3642 - protein, 10 aa, Unknown
  Synthetic Peptide
FLIFFDLFLV

SEQ ID NO: 3643 - protein, 10 aa, Unknown
  Synthetic Peptide
VTCGNGIQVR

SEQ ID NO: 3644 - protein, 9 aa, Unknown
  Synthetic Peptide
ALFFIIFNK

SEQ ID NO: 3645 - protein, 9 aa, Unknown
  Synthetic Peptide
QTNFKSLLR

SEQ ID NO: 3646 - protein, 9 aa, Unknown
  Synthetic Peptide
GVSENIFLK

SEQ ID NO: 3647 - protein, 10 aa, Unknown
  Synthetic Peptide
HVLSHNSYEK

SEQ ID NO: 3648 - protein, 10 aa, Unknown
  Synthetic Peptide
FILVNLLIFH

SEQ ID NO: 3649 - protein, 11 aa, Unknown
  Synthetic Peptide
TPYAGELPAPF

SEQ ID NO: 3650 - protein, 9 aa, Unknown
  Synthetic Peptide
MPLETQLAI

SEQ ID NO: 3651 - protein, 15 aa, Unknown
  Synthetic Peptide
MRKLAILSVSSFLVF

SEQ ID NO: 3652 - protein, 15 aa, Unknown
  Synthetic Peptide
MNYYGKQENWYSLKK

SEQ ID NO: 3653 - protein, 16 aa, Unknown
  Synthetic Peptide
RHNWVNHAVPLAMKLI

SEQ ID NO: 3654 - protein, 15 aa, Unknown
  Synthetic Peptide
VKNVIGPFMKAVCVE

SEQ ID NO: 3655 - protein, 15 aa, Unknown
  Synthetic Peptide
SSVFNVVNSSIGLIM

SEQ ID NO: 3656 - protein, 18 aa, Unknown
  Synthetic Peptide
AGLLGNVSTVSTVLLGGV

SEQ ID NO: 3657 - protein, 15 aa, Unknown
  Synthetic Peptide
KSKYKLATSVLAGLL

SEQ ID NO: 3658 - protein, 15 aa, Unknown
  Synthetic Peptide
GLAYKFVVPGAATPY

SEQ ID NO: 3659 - protein, 15 aa, Unknown
  Synthetic Peptide
KYKIAGGIAGGLALL

SEQ ID NO: 3660 - protein, 9 aa, Unknown
  Synthetic Peptide
YTAVVPLVY

SEQ ID NO: 3661 - protein, 10 aa, Unknown
  Synthetic Peptide
FLPSDYFPSV

SEQ ID NO: 3662 - protein, 10 aa, Unknown
  Synthetic Peptide
FLPSDYFPSV

SEQ ID NO: 3663 - protein, 10 aa, Unknown
  Synthetic Peptide
FLPSDYFPSV

SEQ ID NO: 3664 - protein, 10 aa, Unknown
  Synthetic Peptide
FLPSDYFPSV

SEQ ID NO: 3665 - protein, 10 aa, Unknown
  Synthetic Peptide
FLPSDYFPSV

SEQ ID NO: 3666 - protein, 10 aa, Unknown
  Synthetic Peptide
KVFPYALINK

SEQ ID NO: 3667 - protein, 10 aa, Unknown
  Synthetic Peptide
KVFPYALINK

SEQ ID NO: 3668 - protein, 9 aa, Unknown
  Synthetic Peptide
AYIDNYNKF

SEQ ID NO: 3669 - protein, 10 aa, Unknown
  Synthetic Peptide
KVFPYALINK

SEQ ID NO: 3670 - protein, 10 aa, Unknown
  Synthetic Peptide
KVFPYALINK

SEQ ID NO: 3671 - protein, 11 aa, Unknown
  Synthetic Peptide
STLPETYVVRR

SEQ ID NO: 3672 - protein, 9 aa, Unknown
  Synthetic Peptide
FTQAGYPAL

SEQ ID NO: 3673 - protein, 9 aa, Unknown
  Synthetic Peptide
APRTLVYLL

SEQ ID NO: 3674 - protein, 8 aa, Unknown
  Synthetic Peptide
FLKDYQLL

SEQ ID NO: 3675 - protein, 9 aa, Unknown
  Synthetic Peptide
FRYNGLIHR

SEQ ID NO: 3676 - protein, 9 aa, Unknown
  Synthetic Peptide
FPFKYAAAF

SEQ ID NO: 3677 - protein, 9 aa, Unknown
  Synthetic Peptide
FPFKYAAAF

SEQ ID NO: 3678 - protein, 9 aa, Unknown
  Synthetic Peptide
FPFKYAAAF

SEQ ID NO: 3679 - protein, 9 aa, Unknown
  Synthetic Peptide
AEMGKYSFY

SEQ ID NO: 3680 - protein, 9 aa, Unknown
  Synthetic Peptide
FPFKYAAAF

SEQ ID NO: 3681 - protein, 9 aa, Unknown
  Synthetic Peptide
FPFKYAAAF

SEQ ID NO: 3682 - protein, 9 aa, Unknown
  Synthetic Peptide
FPFKYAAAF

SEQ ID NO: 3683 - protein, 9 aa, Unknown
  Synthetic Peptide
QYDDAVYKL

SEQ ID NO: 3684 - protein, 9 aa, Unknown
  Synthetic Peptide
YRHDGGNVL

SEQ ID NO: 3685 - protein, 9 aa, Unknown
  Synthetic Peptide
YRHDGGNVL

SEQ ID NO: 3686 - protein, 10 aa, Unknown
  Synthetic Peptide
SGPSNTYPEI

SEQ ID NO: 3687 - protein, 8 aa, Unknown
  Synthetic Peptide
RGYVFQGL

SEQ ID NO: 3688 - protein, 10 aa, Unknown
  Synthetic Peptide
RGPYRAFVTI

SEQ ID NO: 3689 - protein, 9 aa, Unknown
  Synthetic Peptide
KFNPMKTYI

SEQ ID NO: 3690 - protein, 12 aa, Unknown
  Synthetic Peptide
IPQSLDSYWTSL

SEQ ID NO: 3691 - protein, 14 aa, Unknown
  Synthetic Peptide
YPKYVKQNTLKLAT

SEQ ID NO: 3692 - protein, 16 aa, Unknown
  Synthetic Peptide
VVHFFKNIVTPRTPPY

SEQ ID NO: 3693 - protein, 14 aa, Unknown
  Synthetic Peptide
YAAFAAAKTAAAFA

SEQ ID NO: 3694 - protein, 12 aa, Unknown
  Synthetic Peptide
YKTIAFDEEARR

SEQ ID NO: 3695 - protein, 14 aa, Unknown
  Synthetic Peptide
YARFQSQTTLKQKT

SEQ ID NO: 3696 - protein, 14 aa, Unknown
  Synthetic Peptide
YARFQRQTTLKAAA

SEQ ID NO: 3697 - protein, 14 aa, Unknown
  Synthetic Peptide
YARFQSQTTLKQKT

SEQ ID NO: 3698 - protein, 14 aa, Unknown
  Synthetic Peptide
YARFQSQTTLKQKT

SEQ ID NO: 3699 - protein, 14 aa, Unknown
  Synthetic Peptide
QYIKANSKFIGITE

SEQ ID NO: 3700 - protein, 14 aa, Unknown
  Synthetic Peptide
QYIKANSKFIGITE

SEQ ID NO: 3701 - protein, 14 aa, Unknown
  Synthetic Peptide
QYIKANSKFIGITE

SEQ ID NO: 3702 - protein, 14 aa, Unknown
  Synthetic Peptide
QYIKANSKFIGITE

SEQ ID NO: 3703 - protein, 14 aa, Unknown
  Synthetic Peptide
QYIKANSKFIGITE

SEQ ID NO: 3704 - protein, 15 aa, Unknown
  Synthetic Peptide
EALIHQLKINPYVLS

SEQ ID NO: 3705 - protein, 14 aa, Unknown
  Synthetic Peptide
QYIKANAKFIGITE

SEQ ID NO: 3706 - protein, 14 aa, Unknown
  Synthetic Peptide
QYIKANAKFIGITE

SEQ ID NO: 3707 - protein, 13 aa, Unknown
  Synthetic Peptide
PKYVKQNTLKLAT

SEQ ID NO: 3708 - protein, 13 aa, Unknown
  Synthetic Peptide
NGQIGNDPNRDIL

SEQ ID NO: 3709 - protein, 14 aa, Unknown
  Synthetic Peptide
YARFQSQTTLKQKT

SEQ ID NO: 3710 - protein, 17 aa, Unknown
  Synthetic Peptide
YAHAAHAAHAAHAAHAA

SEQ ID NO: 3711 - protein, 17 aa, Unknown
  Synthetic Peptide
YAHAAHAAHAAHAAHAA

SEQ ID NO: 3712 - protein, 17 aa, Unknown
  Synthetic Peptide
YAHAAHAAHAAHAAHAA

SEQ ID NO: 3713 - protein, 17 aa, Unknown
  Synthetic Peptide
YNTDGSTDYGILQINSR

SEQ ID NO: 3714 - protein, 17 aa, Unknown
  Synthetic Peptide
YAHAAHAAHAAHAAHAA

SEQ ID NO: 3715 - protein, 17 aa, Unknown
  Synthetic Peptide
YAHAAHAAHAAHAAHAA

SEQ ID NO: 3716 - protein, 16 aa, Unknown
  Synthetic Peptide
YLEDARRKKAIYEKKK

SEQ ID NO: 3717 - protein, 16 aa, Unknown
  Synthetic Peptide
YLEDARRKKAIYEKKK

SEQ ID NO: 3718 - protein, 10 aa, Unknown
  Synthetic Peptide
FLIFFDLFLV

SEQ ID NO: 3719 - protein, 9 aa, Unknown
  Synthetic Peptide
FMKAVCVEV

SEQ ID NO: 3720 - protein, 9 aa, Unknown
  Synthetic Peptide
VLAGLLGNV

SEQ ID NO: 3721 - protein, 9 aa, Unknown
  Synthetic Peptide
GLIMVLSFL

SEQ ID NO: 3722 - protein, 9 aa, Unknown
  Synthetic Peptide
KILSVFFLA

SEQ ID NO: 3723 - protein, 9 aa, Unknown
  Synthetic Peptide
GLLGNVSTV

SEQ ID NO: 3724 - protein, 10 aa, Unknown
  Synthetic Peptide
VLLGGVGLVL

SEQ ID NO: 3725 - protein, 10 aa, Unknown
  Synthetic Peptide
ILSVSSFLFV

SEQ ID NO: 3726 - protein, 9 aa, Unknown
  Synthetic Peptide
QTNFKSLLR

SEQ ID NO: 3727 - protein, 9 aa, Unknown
  Synthetic Peptide
LACAGLAYK

SEQ ID NO: 3728 - protein, 10 aa, Unknown
  Synthetic Peptide
VTCGNGIQVR

SEQ ID NO: 3729 - protein, 9 aa, Unknown
  Synthetic Peptide
ALFFIIFNK

SEQ ID NO: 3730 - protein, 10 aa, Unknown
  Synthetic Peptide
LLACAGLAYK

SEQ ID NO: 3731 - protein, 9 aa, Unknown
  Synthetic Peptide
GVSENIFLK

SEQ ID NO: 3732 - protein, 10 aa, Unknown
  Synthetic Peptide
HVLSHNSYEK

SEQ ID NO: 3733 - protein, 10 aa, Unknown
  Synthetic Peptide
FILVNLLIFH

SEQ ID NO: 3734 - protein, 10 aa, Unknown
  Synthetic Peptide
TPYAGEPAPF

SEQ ID NO: 3735 - protein, 8 aa, Unknown
  Synthetic Peptide
LPYGRTNL

SEQ ID NO: 3736 - protein, 9 aa, Unknown
  Synthetic Peptide
FVEALFQEY

SEQ ID NO: 3737 - protein, 10 aa, Unknown
  Synthetic Peptide
FQDEENIGIY

SEQ ID NO: 3738 - protein, 9 aa, Unknown
  Synthetic Peptide
LPSENERGY

SEQ ID NO: 3739 - protein, 9 aa, Unknown
  Synthetic Peptide
PSDGKCNLY

SEQ ID NO: 3740 - protein, 9 aa, Unknown
  Synthetic Peptide
YYIPHQSSL

SEQ ID NO: 3741 - protein, 9 aa, Unknown
  Synthetic Peptide
FYFILVNLL

SEQ ID NO: 3742 - protein, 9 aa, Unknown
  Synthetic Peptide
KYLVIVFLI

SEQ ID NO: 3743 - protein, 9 aa, Unknown
  Synthetic Peptide
KYKLATSVL

SEQ ID NO: 3744 - protein, 16 aa, Unknown
  Synthetic Peptide
RHNWVNHAVPLAMKLI

SEQ ID NO: 3745 - protein, 15 aa, Unknown
  Synthetic Peptide
HNWVNHAVPLAMKLI

SEQ ID NO: 3746 - protein, 15 aa, Unknown
  Synthetic Peptide
KSKYKLATSVLAGLL

SEQ ID NO: 3747 - protein, 18 aa, Unknown
  Synthetic Peptide
LVNLLIFHINGKIIKNSE

SEQ ID NO: 3748 - protein, 17 aa, Unknown
  Synthetic Peptide
LVNLLIFHINGKIIKNS

SEQ ID NO: 3749 - protein, 15 aa, Unknown
  Synthetic Peptide
LLIFHINGKIIKNSE

SEQ ID NO: 3750 - protein, 15 aa, Unknown
  Synthetic Peptide
GLAYKFVVPGAATPY

SEQ ID NO: 3751 - protein, 15 aa, Unknown
  Synthetic Peptide
SSVFNVVNSSIGLIM

SEQ ID NO: 3752 - protein, 15 aa, Unknown
  Synthetic Peptide
VKNVIGPFMKAVCVE

SEQ ID NO: 3753 - protein, 15 aa, Unknown
  Synthetic Peptide
MRKLAILSVSSFLFV

SEQ ID NO: 3754 - protein, 15 aa, Unknown
  Synthetic Peptide
MNYYGKQENWYSLKK

SEQ ID NO: 3755 - protein, 15 aa, Unknown
  Synthetic Peptide
KYKIAGGIAGGLALL

SEQ ID NO: 3756 - protein, 15 aa, Unknown
  Synthetic Peptide
AGLLGNVSTVLLGGV

SEQ ID NO: 3757 - protein, 15 aa, Unknown
  Synthetic Peptide
QTNFKSLLRNLGVSE

SEQ ID NO: 3758 - protein, 15 aa, Unknown
  Synthetic Peptide
PDSIQDSLKESRKLN

SEQ ID NO: 3759 - protein, 15 aa, Unknown
  Synthetic Peptide
KCNLYADSAWENVKN

SEQ ID NO: 3760 - protein, 9 aa, Unknown
  Synthetic Peptide
GLIMVLSFL

SEQ ID NO: 3761 - protein, 9 aa, Unknown
  Synthetic Peptide
GLLGNVSTV

SEQ ID NO: 3762 - protein, 9 aa, Unknown
  Synthetic Peptide
VLAGLLGNV

SEQ ID NO: 3763 - protein, 9 aa, Unknown
  Synthetic Peptide
KILSVFFLA

SEQ ID NO: 3764 - protein, 9 aa, Unknown
  Synthetic Peptide
FMKAVCVEV

SEQ ID NO: 3765 - protein, 10 aa, Unknown
  Synthetic Peptide
ILSVSSFLFV

SEQ ID NO: 3766 - protein, 10 aa, Unknown
  Synthetic Peptide
VLLGGVGLVL

SEQ ID NO: 3767 - protein, 10 aa, Unknown
  Synthetic Peptide
FLIFFDLFLV

SEQ ID NO: 3768 - protein, 9 aa, Unknown
  Synthetic Peptide
ALFFIIFNK

SEQ ID NO: 3769 - protein, 9 aa, Unknown
  Synthetic Peptide
GVSENIFLK

SEQ ID NO: 3770 - protein, 9 aa, Unknown
  Synthetic Peptide
QTNFKSLLR

SEQ ID NO: 3771 - protein, 9 aa, Unknown
  Synthetic Peptide
LACAGLAYK

SEQ ID NO: 3772 - protein, 10 aa, Unknown
  Synthetic Peptide
VTCGNGIQVR

SEQ ID NO: 3773 - protein, 10 aa, Unknown
  Synthetic Peptide
FILVNLLIFH

SEQ ID NO: 3774 - protein, 10 aa, Unknown
  Synthetic Peptide
HVLSHNSYEK

SEQ ID NO: 3775 - protein, 10 aa, Unknown
  Synthetic Peptide
LLACAGLAYK

SEQ ID NO: 3776 - protein, 8 aa, Unknown
  Synthetic Peptide
LPYGRTNL

SEQ ID NO: 3777 - protein, 10 aa, Unknown
  Synthetic Peptide
TPYAGEPAPF

SEQ ID NO: 3778 - protein, 9 aa, Unknown
  Synthetic Peptide
LPSENERGY

SEQ ID NO: 3779 - protein, 9 aa, Unknown
  Synthetic Peptide
FVEALFQEY

SEQ ID NO: 3780 - protein, 9 aa, Unknown
  Synthetic Peptide
PSDGKCNLY

SEQ ID NO: 3781 - protein, 10 aa, Unknown
  Synthetic Peptide
FQDEENIGIY

SEQ ID NO: 3782 - protein, 9 aa, Unknown
  Synthetic Peptide
KYKLATSVL

SEQ ID NO: 3783 - protein, 9 aa, Unknown
  Synthetic Peptide
FYFILVNLL

SEQ ID NO: 3784 - protein, 9 aa, Unknown
  Synthetic Peptide
YYIPHQSSL

SEQ ID NO: 3785 - protein, 9 aa, Unknown
  Synthetic Peptide
KYLVIVFLI

SEQ ID NO: 3786 - protein, 16 aa, Unknown
  Synthetic Peptide
RHNWVNHAVPLAMKLI

SEQ ID NO: 3787 - protein, 15 aa, Unknown
  Synthetic Peptide
KSKYKLATSVLAGLL

SEQ ID NO: 3788 - protein, 15 aa, Unknown
  Synthetic Peptide
LLIFHINGKIIKNSE

SEQ ID NO: 3789 - protein, 15 aa, Unknown
  Synthetic Peptide
GLAYKFVVPGAATPY

SEQ ID NO: 3790 - protein, 15 aa, Unknown
  Synthetic Peptide
SSVFNVVNSSIGLIM

SEQ ID NO: 3791 - protein, 15 aa, Unknown
  Synthetic Peptide
VKNVIGPFMKAVCVE

SEQ ID NO: 3792 - protein, 15 aa, Unknown
  Synthetic Peptide
MRKLAILSVSSFLFV

SEQ ID NO: 3793 - protein, 15 aa, Unknown
  Synthetic Peptide
MNYYGKQENWYSLKK

SEQ ID NO: 3794 - protein, 15 aa, Unknown
  Synthetic Peptide
KYKIAGGIAGGLALL

SEQ ID NO: 3795 - protein, 15 aa, Unknown
  Synthetic Peptide
AGLLGNVSTVLLGGV

SEQ ID NO: 3796 - protein, 15 aa, Unknown
  Synthetic Peptide
QTNFKSLLRNLGVSE

SEQ ID NO: 3797 - protein, 15 aa, Unknown
  Synthetic Peptide
PDSIQDSLKESRKLN

SEQ ID NO: 3798 - protein, 15 aa, Unknown
  Synthetic Peptide
KCNLYADSAWENVKN

SEQ ID NO: 3799 - protein, 14 aa, Unknown
  Synthetic Peptide
QYIKANSKFIGITE

SEQ ID NO: 3800 - protein, 21 aa, Unknown
  Synthetic Peptide
DIEKKIAKMEKASSVFNVVNS

SEQ ID NO: 3801 - protein, 16 aa, Unknown
  Synthetic Peptide
GAVDSILGGVATYGAA

SEQ ID NO: 3802 - protein, 13 aa, Unknown
  Synthetic Peptide
  MOD_RES (3)..(3): Xaa may be cyclohexylalanine, Phe or Tyr
  MOD_RES (1)..(1): Xaa may be D-alanine or L-alanine
  MOD_RES (13)..(13): Xaa may be D-alanine or L-alanine
XKXVWANTLKAAX

SEQ ID NO: 3803 - protein, 10 aa, Unknown
  Synthetic Peptide
FVIFFDLFLV

SEQ ID NO: 3804 - protein, 9 aa, Unknown
  Synthetic Peptide
FVKAVCVEV

SEQ ID NO: 3805 - protein, 9 aa, Unknown
  Synthetic Peptide
GLIMVLSFV

SEQ ID NO: 3806 - protein, 9 aa, Unknown
  Synthetic Peptide
GVIMVLSFL

SEQ ID NO: 3807 - protein, 9 aa, Unknown
  Synthetic Peptide
GVIMVLSFV

SEQ ID NO: 3808 - protein, 9 aa, Unknown
  Synthetic Peptide
VVAGLLGNV

SEQ ID NO: 3809 - protein, 9 aa, Unknown
  Synthetic Peptide
KLLSVFFLA

SEQ ID NO: 3810 - protein, 9 aa, Unknown
  Synthetic Peptide
KVLSVFFLA

SEQ ID NO: 3811 - protein, 9 aa, Unknown
  Synthetic Peptide
KILSVFFLV

SEQ ID NO: 3812 - protein, 9 aa, Unknown
  Synthetic Peptide
KLLSVFFLV

SEQ ID NO: 3813 - protein, 9 aa, Unknown
  Synthetic Peptide
KVLSVFFLV

SEQ ID NO: 3814 - protein, 9 aa, Unknown
  Synthetic Peptide
GVLGNVSTV

SEQ ID NO: 3815 - protein, 10 aa, Unknown
  Synthetic Peptide
IVSVSSFLFV

SEQ ID NO: 3816 - protein, 10 aa, Unknown
  Synthetic Peptide
VLLGGVGLVV

SEQ ID NO: 3817 - protein, 10 aa, Unknown
  Synthetic Peptide
VVLGGVGLVL

SEQ ID NO: 3818 - protein, 10 aa, Unknown
  Synthetic Peptide
VVLGGVGLVV

SEQ ID NO: 3819 - protein, 9 aa, Unknown
  Synthetic Peptide
LVCAGLAYK

SEQ ID NO: 3820 - protein, 9 aa, Unknown
  Synthetic Peptide
QVNFKSLLR

SEQ ID NO: 3821 - protein, 10 aa, Unknown
  Synthetic Peptide
VVCGNGIQVR

SEQ ID NO: 3822 - protein, 9 aa, Unknown
  Synthetic Peptide
AVFFIIFNK

SEQ ID NO: 3823 - protein, 10 aa, Unknown
  Synthetic Peptide
LVACAGLAYK

SEQ ID NO: 3824 - protein, 10 aa, Unknown
  Synthetic Peptide
FVLVNLLIFH

SEQ ID NO: 3825 - protein, 10 aa, Unknown
  Synthetic Peptide
FILVNLLIFR

SEQ ID NO: 3826 - protein, 10 aa, Unknown
  Synthetic Peptide
FILVNLLIFK

SEQ ID NO: 3827 - protein, 10 aa, Unknown
  Synthetic Peptide
FVLVNLLIFR

SEQ ID NO: 3828 - protein, 10 aa, Unknown
  Synthetic Peptide
FVLVNLLIFK

SEQ ID NO: 3829 - protein, 10 aa, Unknown
  Synthetic Peptide
TPYAGEPAPI

SEQ ID NO: 3830 - protein, 8 aa, Unknown
  Synthetic Peptide
LPYGRTNI

SEQ ID NO: 3831 - protein, 10 aa, Unknown
  Synthetic Peptide
FTDEENIGIY

SEQ ID NO: 3832 - protein, 9 aa, Unknown
  Synthetic Peptide
FVDALFQEY

SEQ ID NO: 3833 - protein, 9 aa, Unknown
  Synthetic Peptide
FTEALFQEY

SEQ ID NO: 3834 - protein, 9 aa, Unknown
  Synthetic Peptide
LPDENERGY

SEQ ID NO: 3835 - protein, 9 aa, Unknown
  Synthetic Peptide
LTSENERGY

SEQ ID NO: 3836 - protein, 9 aa, Unknown
  Synthetic Peptide
PTDGKCNLY

SEQ ID NO: 3837 - protein, 9 aa, Unknown
  Synthetic Peptide
FYFILVNLF

SEQ ID NO: 3838 - protein, 9 aa, Unknown
  Synthetic Peptide
KYKLATSVF

SEQ ID NO: 3839 - protein, 9 aa, Unknown
  Synthetic Peptide
KYLVIVFLF

SEQ ID NO: 3840 - protein, 9 aa, Unknown
  Synthetic Peptide
YYIPHQSSF

SEQ ID NO: 3841 - protein, 9 aa, Unknown
  Synthetic Peptide
  MISC_FEATURE (1)..(1): May be Met, Phe, Leu, Ile, Val, Trp or Tyr
  MISC_FEATURE (5)..(5): May be any amino acid
  MISC_FEATURE (6)..(6): May be Ile, Val, Met, Ser, Ala, Cys, Thr, Pro or Leu
  MISC_FEATURE (8)..(8): May be any amino acid
  MISC_FEATURE (9)..(9): May be Ile or Val
XMWAXXMXX

SEQ ID NO: 3842 - protein, 9 aa, Unknown
  Synthetic Peptide
  MISC_FEATURE (1)..(1): May be any amino acid
  MISC_FEATURE (3)..(3): May be any amino acid
  MISC_FEATURE (5)..(6): May be any amino acid
  MISC_FEATURE (7)..(7): May be Gly, Arg or Asp
XCXGXXXNG

What is claimed is:

1. A conjugate of an isolated peptide less than 13 amino acids in length comprising the oligopeptide GVSENIFLK (SEQ ID NO:3731) and a T helper peptide; wherein said T helper peptide is less than about 50 amino acids in length and wherein said T helper peptide comprises a pan-DR binding epitope.

2. A composition comprising the conjugate of claim 1 and a carrier.

3. The conjugate of claim 1, wherein the isolated peptide is GVSENIFLK (SEQ ID NO:3731).

4. The conjugate of claim 1, wherein said pan-DR binding epitope is aKXVWANTLKAAa (SEQ ID NO:3802), where "X" is either cyclohexylalanine, phenylalanine, or tyrosine, and "a" is either D-alanine or L-alanine.

* * * * *